(12) United States Patent
Pignede et al.

(10) Patent No.: US 10,738,329 B2
(45) Date of Patent: Aug. 11, 2020

(54) USE OF MCM7 TO OBTAIN ACETIC ACID-RESISTANT YEAST STRAINS

(71) Applicant: LESAFFRE et COMPAGNIE, Paris (FR)

(72) Inventors: Georges Pignede, Marcq en Baroeul (FR); Thomas Desfougeres, Dissay (FR)

(73) Assignee: LESAFFRE et COMPAGNIE, Paris (FR)

( * ) Notice: Subject to any disclaimer, the term of this patent is extended or adjusted under 35 U.S.C. 154(b) by 0 days.

(21) Appl. No.: 16/331,077

(22) PCT Filed: Aug. 31, 2017

(86) PCT No.: PCT/FR2017/052316
§ 371 (c)(1),
(2) Date: Mar. 6, 2019

(87) PCT Pub. No.: WO2018/046820
PCT Pub. Date: Mar. 15, 2018

(65) Prior Publication Data
US 2019/0367951 A1    Dec. 5, 2019

(30) Foreign Application Priority Data
Sep. 8, 2016 (FR) ..................................... 16 58370

(51) Int. Cl.
| | | |
|---|---|---|
| C12P 7/06 | (2006.01) | |
| C12P 7/10 | (2006.01) | |
| C12N 1/36 | (2006.01) | |
| C12N 1/16 | (2006.01) | |
| C07K 14/395 | (2006.01) | |
| C12N 1/18 | (2006.01) | |
| C12N 15/81 | (2006.01) | |

(52) U.S. Cl.
CPC ............. *C12P 7/06* (2013.01); *C07K 14/395* (2013.01); *C12N 1/18* (2013.01); *C12N 15/81* (2013.01)

(58) Field of Classification Search
CPC ..... C12N 1/36; C12N 1/16; C12P 7/06; C12P 7/10; C12R 1/865
See application file for complete search history.

(56) References Cited

FOREIGN PATENT DOCUMENTS

| WO | WO-2010/000464 A1 | 1/2010 |
|---|---|---|
| WO | WO-2012/072793 A1 | 6/2012 |
| WO | WO-2013/178915 A1 | 12/2013 |

OTHER PUBLICATIONS

Akada et al., Screening and identification of yeast sequences that cause growth inhibition when overexpressed (Abstract Only), *Mol. Gen. Genet.* 254:267-74 (1997).
Akada et al., Sets of integrating plasmids and gene disruption cassettes containing improved counter-selection markers designed for repeated use in budding yeast (Abstract Only), *Yeast.* 19:393-402.
Fitch et al., Mcm7, a subunit of the presumptive MCM helicase, modulates its own expression in conjunction with Mcm1, *J. Biol. Chem.* 278:25408-16 (2003).
Internatioanl Search Report and Written Opinion, PCT/FR2017/052316 (dated Oct. 26, 2017).
Kawahata et al., A positive selection for plasmid loss in *Saccharomyces cerevisiae* using galactose-inducible growth inhibitory sequences (Abstract Only), *Yeast.* 15:1-10 (1999).
Lander et al., Mapping mendelian factors underlying quantitative traits using RFLP linkage maps (Abstract Only), *Genetics.* 121:185-99 (1989).
Lee et al., Transcriptome analysis of acetic-acid-treated yeast cells identifies a large set of genes whose overexpression or deletion enhances acetic acid tolerance, *Appl. Microbiol. Biotechnol.* 99:6391-6403 (2015).
Mira et al., Genomic expression program involving the Haa1p-regulon in *Saccharomyces cerevisiae* response to acetic acid, *OMICS.* 14:587-601 (2010).
Mira et al., Identification of a DNA-binding site for the transcription factor Haa1, required for *Saccharomyces cerevisiae* response to acetic acid stress (Abstract Only), *Nucleic Acids Res.* 39:6896-907 (2011).
NCBI Database Accession No. 852501, MCM7 mini-chromosome maintenance complex protein 7 [ *Saccharomyces cerevisiae* S288C ], Sep. 9, 2018.
NCBI Database Accession No. GCA-000146045.2, *Saccharomyces cerevisiae* S288C (baker's yeast), Apr. 18, 2011.
NCBI Database Accession No. NC_001134.7, *Saccharomyces cerevisiae* S288c chromosome II, complete sequence, Dec. 23, 2010.
Parts et al., Revealing the genetic structure of a trait by sequencing a population under selection (Abstract Only), *Genome Res.* 21:1131-8 (2011).

*Primary Examiner* — Maryam Monshipouri
(74) *Attorney, Agent, or Firm* — Marshall, Gerstein & Borun LLP

(57) ABSTRACT

The invention concerns the use of the MCM7 gene to confer resistance to an organic acid, preferably acetic acid, to a yeast strain during glucose fermentation.

14 Claims, 5 Drawing Sheets
Specification includes a Sequence Listing.

A/

B/

USE OF MCM7 TO OBTAIN ACETIC ACID-RESISTANT YEAST STRAINS

CROSS REFERENCE TO RELATED APPLICATIONS AND INCORPORATION BY REFERENCE OF MATERIAL SUBMITTED ELECTRONICALLY

This application is a U.S. National Stage of International Application No. PCT/FR2017/052316, filed Aug. 31, 2017, which claims the benefit of French Patent Application No. 1658370, filed Sep. 8, 2016, the entire contents of each of which are fully incorporated herein by reference.

A Sequence Listing, which is a part of the present disclosure, is submitted concurrently with the specification as a text file. The name of the text file containing the Sequence Listing is "53904_SubSeqlisting.txt." The Sequence Listing was created on Apr. 9, 2019, and is 1,059,363 bytes in size. The subject matter of the Sequence Listing is incorporated herein in its entirety by reference.

FIELD OF THE INVENTION

The present invention relates to the use of regulation for the expression of the MCM7 gene to confer resistance to an organic acid, advantageously acetic acid, to a yeast strain during glucose fermentation. Accordingly, the presence, at least at an allele, of a binding site for the transcription regulator Haa1p upstream of the MCM7 gene would induce its expression, which translates by increased resistance to the organic acid.

Moreover, the present invention offers a method allowing the genotypic selection of a yeast strain resistant to an organic acid, advantageously acetic acid, during the glucose fermentation. In the same way, the invention allows for substantial optimization of the yielded yeast strains resistant to an organic acid, advantageously acetic acid, based on the genotypic selection of the spores.

BACKGROUND OF THE INVENTION

The capacity of genetically modified yeasts to ferment diverse substrates makes them a tool of choice in diverse industrial processes, particularly in the production of ethanol from lignocellulose biomass. Alcoholic fermentation is the process yeasts use in anaerobic media during which sugars are transformed into alcohol. The yeast *Saccharomyces cerevisiae*, also know as "baker's yeast," remains the microorganism used most often for alcoholic fermentation.

However, some fermentation inhibitors are found naturally in these substrates and negatively impact ethanol production. This is in particular the case for weak organic acids, particularly for acetic acid, a degradation product of hemicellulose. When yeasts are confronted with the presence of organic acid in their environment, they block their cellular cycle to be able to prepare to react to this new abiotic stress. The fermentation only starts once the cellular resistance machinery is in place. The presence of a weak organic acid accordingly has the consequence of delaying the initiation of the fermentation on glucose, thereby increasing production costs.

The problem related to acetic acid is all the more crucial since it is a very powerful inhibitor for alcoholic fermentation by yeasts and it is found in high concentrations in some fermentation media.

Various means have been described to attempt to counter the effect of fermentation inhibitors, such as for instance detoxifying the fermentation medium, or adapting yeasts to fermentation inhibitors by acclimation or genetic modification. In the case of acetic acid, detoxifying the fermentation medium is a difficult option to implement, particularly industrially. It is therefore necessary to attempt to modify the yeasts themselves.

In this context, the acclimation of yeasts can be achieved by adding the inhibitor into the culture medium, preferably at increasing doses. However, it has been observed that yeast adaptation according to this method is only transient, and disappears quickly when they are again cultivated in a medium devoid of inhibitor. So the method proves to be of little industrial interest, as there phenotypically stable strains are necessary.

In the case of sensitivity to acetic acid, only the genetic modification of yeasts can therefore be envisaged. This can be done either by modification by genetic engineering, targeting specific genes, or classically by crossing strains of interest. Currently, the molecular mechanisms related to the sensitivity or on the contrary the resistance to acetic acid are poorly understood, and insufficient for the methods targeted by genetic engineering.

Accordingly, the method of choice to improve resistance to acetic acid remains yielding yeasts by crossing. However, even though some methods have yielded acetic-acid resistant yeast strains, these are by definition random and cannot guarantee success.

Document WO 2013/178915 describes crossing processes for yeast strains that allow the production of yeasts that can metabolize glucose and are acetic-acid resistant. This method consists in crossing the yeast strain filed at the CNCM under the number I-4538 with the yeast strain filed at the CNCM under the number I-4627, then in selecting a hybrid that can metabolize xylose and, independently, resist acetic acid during the fermentation of glucose.

This hybridization method relies on the capacity of yeasts to reproduce either asexually, or sexually, according to the culture conditions in particular.

Yeast *S. cerevisiae* is an organism with a haplodiplontic reproductive cycle, i.e. an organism capable of actively multiplying both in the haploid and the polyploid, for example diploid, state.

As long as the medium is favorable, polyploid yeasts are capable of vegetative multiplication by sprouting giving rise to polyploid yeasts. In the case of a medium poor in nitrogen-containing nutrients and containing only a non-fermentable carbon source (for example glycerol, acetate, etc.), the heterozygote cells for the Mat locus enter into meosis and form yeasts having lower ploidy (spores or segregants) by a mechanism called sporulation.

Segregants can multiply by sprouting, giving yeasts having the same genome. Among haploid yeasts two opposing sexual signs are distinguished, called MATa and MATα. Two haploid spores with opposite sexual type can fertilize to yield a diploid yeast.

The haplodiplontic cycle for *S. cerevisiae* has been widely used to cross sexually compatible segregants (MATa and MATα), particularly in the method called random recombination from mass sporulation and hybridization. In a classic manner, two parental diploid strains (different from the genomic point of view) are used. The sporulation of parental diploid strains is typically induced by cultivating them in conditions where the nitrogen supply is limited and only in the presence of a non-fermentable carbon source. The meiosis operating during this step leads to a genetic cross-fertilization, creating spores with varied genotype. The spores (haploid) obtained for each of the parental strains are then put in contact, to produce diploid (hybrid) strains by fusion. This last step is called the hybridization step.

This method is interesting in that it allows the creation of genetic cross-fertilization from which interesting phenotype traits can emerge. It does however require a step of selecting hybrids on the basis of desired phenotype traits. As an example, in the case of strictly diploid parental strains each presenting a phenotype trait borne by 10 genes, the probability of obtaining the hybrid of interest is estimated at $1/2.097.10^6$. The final selection step is tedious, long and expensive, especially.

Therefore an obvious need exists for improved production methods for acetic-acid resistant yeast strains.

DESCRIPTION OF THE INVENTION

The inventors have identified that the yeast strains of *S. cerevisiae* capable of having expression of MCM7 induced by an organic acid, particularly acetic acid, have a phenotype of resistance to this organic acid. As shown in the experimental section, the growth of these strains and their capacity to ferment the glucose in a medium rich in acetic acid are improved.

In a particularly interesting manner, the inventors have determined that the expression of MCM7 in these strains can be induced by acetic acid. In addition it appears that this expression of MCM7, induced by acetic acid, is mediated by the transcription factor Haa1p. This is particularly surprising, given that MCM7 is not known as being a gene regulated by Haa1p. Accordingly, the work of Mira and collaborators published in 2010 (Mira et al, 2010, OMICS, 14: 587-601) proposes a list of genes regulated by Haa1p in the strain BY4741, which does not include MCM7. The inventors did establish though that in the strains of *S. cerevisiae* that resist acetic acid, the region upstream of the MCM7 coding gene comprises a motif known to be a binding site for Haa1p. Without being bound to any theory, the presence of this binding site for Haa1p would be the fruit of single-nucleotide polymorphism (SNPs).

On the basis of these elements, the inventors have developed selection and production methods for acetic-acid resistant strains of *S. cerevisiae*.

Definitions

The term "yeast strain" denotes in the sense of the invention a yeast population strictly identical from a genetic point of view. This encompasses both strains referred to as laboratory strains and those referred to as industrial strains. This term is to be differentiated from the term "yeast," a yeast being obtained by the culture of a strain as defined above. In the context of the invention, "yeast" is understood as a commercial product obtained by implementation of a production method for a yeast strain. Thus, yeasts having different properties can be obtained from a single strain, where these differences are connected with the production method implemented.

In the meaning of the invention, a "segregant" is the product of the meiosis of a yeast strain, regardless of the ploidy level of said yeast. In the remainder of the application, the terms "segregant" and "spore" can be used interchangeably.

The term "yeast strain able to metabolize glucose" denotes in the sense of the invention a yeast strain capable of converting glucose into ethanol, i.e. capable of fermenting glucose. A yeast strain able to metabolize glucose within the meaning of the invention is a yeast strain that converts at least 70%, preferably at least 80%, and more preferably at least 90% of the glucose into ethanol in 60 hours in a fermentation medium comprising 150 g of glucose per kg of fermentation medium, in usual conditions for alcoholic fermentation.

Preferably, the method used to measure the percentage of glucose converted into ethanol is as follows:

The yeast strain used is inoculated in synthetic fermentation medium at 0.25 g of yeast in dry matter/kg of fermentation medium. The 60 hour duration is calculated from the inoculation of the fermentation medium with the yeast strain. A synthetic fermentation medium is a medium whose exact chemical composition is known. In the scope of the invention, a synthetic fermentation medium comprises a carbon source, a nitrogen source, a phosphorus source, and the essential vitamins and minerals for the growth of a yeast strain. Preferably, the fermentation medium used to measure the percentage of glucose converted into ethanol is YF as defined in the example embodiments (denoted YF Ac because of the presence of acetic acid).

The fermentation is typically conducted at a temperature comprised between 28 and 37° C., or between 30 and 35° C., advantageously equal to 32° C., with moderate stirring, for example at 90 or 100 rpm. The stirring is moderate so as to not be oxygenating. The pH of the medium is preferably controlled, for example by the buffering power of an acid/base pair (such as the acetic acid/acetate pair), and acid, advantageously comprised between 3.5 and 6, or 4 and 5.5, even more advantageously equal to 4.4 or 5.

The amount of ethanol present in the fermentation medium is measured by any appropriate means known to the person skilled in the art. It can be a direct measurement of the ethanol produced or an indirect measurement through a parameter correlated to ethanol production, such as $CO_2$ production determined by measuring the mass lost. For example, the production of alcohol may be measured by chromatography, including HPLC (High Performance Liquid Chromatography), an enzymatic kit (for example the determination of ethanol by Boehringer kit), or a determination by potassium dichromate. The amount of glucose in the fermentation medium is measured by any appropriate means known to the person skilled in the art, preferably by chromatography, in particular HPLC.

In the context of the invention, "organic acid" or "weak organic acid" is understood to mean a carboxylic acid that can inhibit the fermentation of a sugar, advantageously glucose. It advantageously involves acetic acid, levulinic acid, or formic acid, still more advantageously acetic acid.

It should be noted that it is known that only the non-dissociated or non-ionized form of such acids have inhibition ability. In the context of the invention, "un-ionized or non-dissociated form" of a carboxylic acid is understood as the protonated form thereof. In practice, the form of such organic acids depends on the pH of the medium in which they are incorporated. At a pH greater than the pKa of the acid, the acid will be mostly found in dissociated form or $COO^-$ ions. In contrast and at a lower pH, the majority form is the non-dissociated or unionized form (COOH). In the remainder of the invention, the quantities or concentrations stated refer to acetic acid added to the medium, containing dissociated and undissociated forms according to the pH of said medium.

The terms "resistant to an organic acid" or "acetic-acid resistant" denote a yeast strain that can ferment at least one sugar, particularly glucose, with the organic/acetic acid having limited impact on the alcoholic fermentation curve. The alcoholic fermentation curve representing the quantity of alcohol produced as a function of time generally includes three phases: a latency phase during which there is not ethanol production, an alcohol production phase, and a plateau phase, which corresponds to the end of the fermentation.

In a known manner, acetic acid inhibits glucose fermentation, this inhibition translating as a delay during initiation of fermentation with the kinetics subsequently remaining unchanged. It should be noted that in the presence of both glucose and xylose in the medium, yeast strains ferment glucose first because of catabolite repression.

Accordingly, an "acetic-acid resistant strain" advantageously delays the initiation of alcoholic fermentation by less than 30 hours, preferably less than hours, more preferably less than 15 hours, perhaps 10 hours. Preferably, reference is made to capacity to ferment glucose with a delay in initiation of alcoholic fermentation as indicated above.

The fermentation medium used to assess resistance to acetic acid is preferably a synthetic medium, more preferably the medium YFAc as illustrated in the embodiment examples. The composition of medium YFAc is as follows: 150 g/kg of glucose, 5 g/kg of yeast extract, 4.7 g/kg of DAP (diammonium phosphate), 11.4 g/kg of citric acid, 4 g/kg of acetic acid, 13.5 g/kg of sodium citrate, 1 mL/kg of Tween 80, 2 mL/kg of $ZnSO_4$ (at 10.6 g/L), 2.5 ml/kg of $MgSO_4$ $7H_2O$ (at 400 g/L), 1 mL/kg of thiamine (at 18.24 g/L), 1 mL/kg of pyridoxine (at 5.28 g/L), 1 mL/kg of biotin (at 1.76 g/L), 1 mL/kg of panthotenate (at 3.8 g/L), 2.5 mL/kg of nicotinic acid (at 8 g/L), 1 mL/kg of mesoinositol (at 50 g/L), 1 mL/kg of riboflavin (at 1 g/L), 1 mL/kg of para-aminobenzoate (at 1.2 g/L), pH adjusted to 4.4 with KOH. The inoculation of the yeast strain used to evaluate resistance to acetic acid is preferably 0.25 g dry matter/kg of fermentation medium. The time t=0 of the alcoholic fermentation corresponds to the time when the fermentation medium is inoculated with the yeast strain. Alcoholic fermentation should be conducted preferably at 32° C. under medium stirring, for example 90 rpm.

Note that at the concentration of 2000 ppm, acetic acid does not inhibit the fermentation. In a suitable manner, acetic acid is added at from 1 to 10 g/kg of fermentation medium, for example 4 g/kg of fermentation medium In the sense of the invention, "MCM7" denotes the gene coding the protein Mcm7p also called protein Cdc47p, and the product of the expression of this gene.

"Gene coding Mcm7p" or "MCM7 gene" are understood in the sense of the invention the gene of the yeast *Saccharomyces cerevisiae* located on chromosome II between the 625767 and 628304 positions, corresponding to ORF (Open Reading Frame) coding Mcm7p. These positions are indicated in reference to the genome of the yeast strain *S. cerevisiae* S288c, particularly its complete sequence, available in the databases under reference GenBank GCA_000146045.2. (version of Apr. 18, 2011), and whose NCBI reference is Gene ID: 852501. The sequence of chromosome II, used as a reference sequence for numbering, is that accessible under number NCBI NC_001134.7 (23 Dec. 2010; SEQ ID NO: 1).

The term "upstream of gene" must be understood in its generally accepted meaning in molecular biology, i.e. as meaning the region located at 5' (of the coding strand) of the initiation site for the gene transcription. In a classic manner, this region (also called "promoter/regulatory region") is involved in the expression of MCM7 gene, comprising in particular promoter and regulatory sequences, such as binding sites for transcription regulators. In the sense of the invention, this region is constituted of the 1200 5' nucleotides at the initiation site of the transcription of the gene encoding Mcm7p.

"Induction of the expression of MCM7 by or in the presence of an organic acid" or "overexpression of MCM7 by or in the presence of an organic acid," is understood in the presence of the invention to mean an increase in the level of expression of the gene encoding Mcm7p in the presence of organic acid, in comparison with the level of expression of this gene in the same strain in the absence of the organic acid. This increase in expression can translate to the nucleotide level (increased mRNA) or to the protein level. The person skilled in the art will therefore be able to choose the measurement method that seems the most appropriate to him and the simplest to implement among the well known methods of molecular biology and biochemistry (Northern blot, PCR, Western blot, etc.).

In the sense of the invention, the terms "induction of the expression of MCM7 mediated by the transcription factor Haa1p" or "overexpression of MCM7 mediated by the transcription factor Haa1p" mean that the induction of the expression or the overexpression of MCM7 targeted in the present application depend on transcription factor Haa1p. In other words, in the absence of transcription factor Haa1p, for example for the yeasts in which this gene is deleted or carries mutation(s) that make it non-functional, or even in conditions where the level of Haa1p is limited, yeasts are no longer capable of inducing the expression of MCM7, in particular in the presence of organic acid.

In the context of the invention, "Haa1p binding site" is understood to mean the nucleotide sequence recognized by the Haa1p transcription factor, allowing it to bind at the target gene whose transcription level is then regulated by Haa1p. According to Mira et al. (*Nucleic Acid Research*, 2011, 39 (16):6896-6907), the minimum motif recognized by Haa1 has the following sequence:

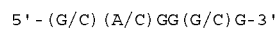

instead of motif-5'-GNN(G/C)(A/C)(A/G)G(A/G/C)G-3', determined previously in silico.

DETAILED DESCRIPTION OF THE INVENTION

According to a first aspect, the invention relates to the use of the MCM7 gene to confer resistance to an organic acid on or to a yeast strain.

According to an advantageous embodiment, the resistance conferred is resistance to acetic acid, whose presence in high concentrations in the lignocellulose hydrolysates is intrinsically related to that of acetyl groups associated in a covalent manner with the hemicellulose molecules.

According to another advantageous embodiment, the resistance to the organic acid in the yeast strain translates during the glucose fermentation, for which the delay in initiation of fermentation is lessened or reduced.

Advantageously, the use of the MCM7 gene is of interest when it is induced, advantageously in the presence of the organic acid in question, in particular of acetic acid.

Even more advantageously, the expression of the MCM7 gene induced by the presence of the organic acid is mediated by the transcription factor Haa1p. In an appropriate manner, the sequence upstream of the MCM7 gene comprises a binding site for Haa1p.

According to a specific embodiment, the sequence upstream of the MCM7 gene comprises the following sequence:

GAGGGG or

GAGGAGGGG or

SEQ ID NO: 2 or

SEQ ID NO: 3 or

SEQ ID NO: 4.

According to another embodiment, the sequence upstream of the MCM7 gene has at least one of the following characteristics:

a T at position 624536;
a T at position 624732;
a G at position 624736;
a C at position 624758;
a G at the 624794 position 624794;
an A at position 624801;
an A at position 624832;
a C at position 625073;
a G at position 625146;
an A at position 625199.

As already stated and in the scope of the invention, the position number corresponds to that of the reference strain S288c. Therefore "position" must be understood as the position, in the strain studied, that corresponds to the given position.

According to a preferred embodiment, the sequence upstream of the MCM7 gene has at least one G at position 624794. According to another embodiment, it has a C at position 624758, a G at position 624794 and an A at position 624801, or all of the characteristics set out above.

According to a preferred embodiment, the yeast strain targeted by the present invention belongs to the Hemiascomycetes group. Preferred strains belong to the *Saccharomyces*, *Pichia* and *Yarrowia* genera, advantageously *Saccharomyces*. Among *Saccharomyces*, it advantageously concerns *Saccharomyces cerevisiae*.

According to another feature, the invention concerns a selection process for a yeast strain resistant to an organic acid comprising:

the demonstrated induction of the expression of the MCM7 gene in the presence of the organic acid; and/or the demonstrated presence, at least at one allele of the strain, of a Haa1p binding site in the sequence upstream of the MCM7 gene, advantageously the sequence GAGGGG or GAGGAGGGG or SEQ ID NO: 2 or SEQ ID NO: 3 or SEQ ID NO: 4; and/or the demonstrated presence, at least at one allele of the strain, of the presence of a base G at position 624794 on chromosome II.

As already stated, the organic acid is advantageously acetic acid.

According to another preferred embodiment, the resistance to the organic acid of the resulting selected strain is observed during its glucose fermentation.

Accordingly, the present invention offers a genotypic screening method for strains of interest, here resistant to an organic acid. This approach is much less expensive, in terms of both time and money, than phenotypic screening traditionally used.

As set out, 3 criteria can be evaluated:

The first criterion consists in evaluating the strain's capacity to induce the expression of MCM7 in the presence of organic acid. As already stated, this induction of expression can be evaluated by any technique known to the person skilled in the art at the level of either the transcription or the protein.

The second criterion relies on the presence, at 5' of MCM7, of a Haa1p binding site. Accordingly, and in a suitable manner, the region located upstream of MCM7 comprises the sequence (G/C)(A/C)GG(G/C)G, perhaps GNN(G/C)(A/C)(A/G)G(A/G/C)G (where N is a nucleotide chosen from A, C, G and T).

According to a specific embodiment, this region contains at least one sequence chosen from:

GAGGGG corresponding to a minimum Haa1p binding site;

GAGGAGGGG corresponding to the motif recognized by Haa1p, determined in silico;

The sequence SEQ ID NO: 2;
The sequence SEQ ID NO: 3;
The sequence SEQ ID NO: 4;
advantageously the sequence SEQ ID NO: 3 or 4.

These sequences can be demonstrated by any technique known to the person skilled in the art such as sequencing, PCR, hybridization.

As is shown in the example embodiments, this may relate only to one allele of this strain, perhaps to several, perhaps even to all the alleles (two in the case of a diploid yeast).

According to a third criterion, the strain presents, at least at one allele, a base G at the position corresponding to the 624794 position of chromosome II, indicated in bold in the corresponding sequence in the minimum Haa1p binding site (GAGGGG). Note that an A is observed in this position in non-acetic-acid resistant strains. Without wanting to be bound by any category, the replacement of a base A by a base G allows the creation of a functional Haa1p binding site, allowing the induction of the expression of MCM7 in the presence of acetic acid.

Note that other mutations can be found in this region, advantageously chosen from:

a T at the 624536 position;
a T at the 624732 position;
a G at the 624736 position;
a C at the 624758 position;
an A at the 624801 position;
an A at the 624832 position;
a C at the 625073 position;
a G at the 625146 position;
an A at the 625199 position.

According to a specific embodiment, a strain targeted by the invention is selected because of the presence of at least one base G at the position corresponding to the 624794 position of chromosome II, perhaps of at least one C at the 624758 position, a G at the 624794 position and an A at the 624801 position, perhaps even because of the 10 nucleotides mentioned above in relation with the specific positions stated, at least in one of its alleles.

The demonstration or identification of these mutations is easily achieved by the person of skill in the art, for example by sequencing the positions of interest.

The interest of a strain identified using this method can of course be confirmed by a phenotypic approach, consisting of evaluating the capacity of the strain selected to ferment glucose in the presence of acetic acid, for example as described above.

These various genotypic screening criteria can also be implemented to produce or obtain yeast strains resistant to an organic acid, advantageously acetic acid, particularly in the context of glucose fermentation.

Accordingly and using the available molecular biology tools, it is possible to do mutagenesis (directed or random) on yeast strains to obtain the desired phenotype. As already stated, the presence of the genotypic characteristics stated above is only a priori necessary at one allele. Alternatively, this mutagenesis can therefore be achieved on spores (or segregants) that are then hybridized with other spores, optionally from another strain presenting another phenotypic trait of interest.

Advantageously, the invention proposes a method for obtaining a yeast strain resistant to an organic acid, based on a genotypic screening conducted in haploid spores or segregants.

Accordingly and according to another feature, the invention proposes a method for obtaining a yeast strain resistant to an organic acid comprising:

a sporulation step for two parental strains having different genomes or divergent phenotypic traits;

a mass hybridization step for the spores or segregants obtained, said process comprising at least one selection step of spores or segregants because of their capacity to induce the expression of MCM7 in the presence of organic acid and/or the presence of a Haa1p binding site in the sequence upstream of MCM7, advantageously the demonstration of the sequence SEQ ID NO: 3 or SEQ ID NO: 4, and/or the presence of a base G at the 624794 position of chromosome II.

In a characteristic manner, the method of the invention comprises a step of sporulation of the parental strains. This technique is well known to the person skilled in the art and does not therefore require further description. As an example, the sporulation step can be conducted by cultivating the parental strains in appropriate culture conditions, such as for example in a deprived medium.

Among the parental strains, at least one of them has the phenotype of interest, here resistance to an organic acid, advantageously acetic acid, in the sense of the invention. Advantageously, this delays initiation of alcoholic fermentation less than 30 h, preferably less than 20 hours, more preferably less than 15 hours perhaps 10 hours in the fermentation medium YFAc with an inoculum of 0.25 g of dry matter of yeast/kg of medium. Such strains are well known to the person skilled in the art. If need be, the person skilled in the art will be able to produce the parental yeast strain resistant to the organic/acetic acid in the sense of the invention, for example by the usual techniques using selection pressure.

Note that a parental strain of interest can also be identified using a selection method, the subject-matter of the present invention.

In the specific case of the use of S. cerevisiae, it may in particular be strain EGAc1 filed under the Budapest treaty at the CNCM (Collection Nationale de Cultures de Microorganismes, Institut Pasteur, 25 rue du Doctor Roux, 75724 Paris Cedex 15) under number I-4839 on Mar. 13, 2014.

As shown in the context of the present application, where this phenotypic trait is optionally carried by only one allele, sporulation gives rise to spores not bearing this genotypic trait, here half of the spores in the case of a diploid parental strain bearing only one allele with resistance to organic/acetic acid.

In a specific case, the two parental strains used in the context of the method of the invention have a phenotype of resistance to an organic acid in the sense of the invention.

In a suitable manner, at least one of the parental yeast strains, particularly that resistant to organic/acetic acid, advantageously both parental strains, can ferment glucose in the sense of the invention.

According to a preferred embodiment, the second parental yeast strain, advantageously the one not having resistance to organic/acetic acid, has a second phenotypic trait of interest. This is for example the capacity to metabolize pentoses, particularly glucose present in large quantities in lignocellulose hydrolysates.

Accordingly, yeast strains that can ferment glucose and also metabolize pentoses are available:

As an example, document WO 2010/000464 reports obtaining yeast strains able to ferment pentoses because of a bacterial gene coding for a xylose isomerase (XI) which converts xylose into xylulose which can be metabolized by the yeast. As an alternative, a eukaryotic pathway should be noted comprising xylose reductase (XR or XYL1) generating xylitol and a xylitol dehydrogenase (XDH or XYL2) that can also produce xylulose.

Thus, document WO 2012/072793 describes improved yeast strains combining exogenous genes coding a xylose isomerase and a xylitol dehydrogenase with which to eliminate xylitol which proves to be an inhibitor of xylose isomerase. Such strains, in particular the strain registered under the Budapest treaty with the CNCM (Collection Nationale de Cultures de Microorganismes) on Oct. 5, 2011 under number I-4538, have improved yields and therefore proven industrial utility for the production of ethanol.

In that respect and according to a specific embodiment, a second parental strain used in the context of the method of the invention is the strain registered under the Budapest treaty with the CNCM (Collection Nationale de Cultures de Microorganismes, Institut Pasteur, 25 rue du Doctor Roux, 75724 Paris Cedex 15) under number I-4538 on Oct. 5, 2011.

The method of the invention further comprises a mass hybridization step for the spores or segregants obtained.

This step is easily carried out according to conventional methods used in the field and described in detail in chapter 7 "Sporulation and Hybridization of Yeast" by R. R. Fowell, in the reference work "The Yeasts", Volume 1, edited by A. H. Rose and J. S. Harrison, 1969-Academic Press. In brief, the hybridization is achieved by adding the spores in question to a suitable culture in the hybridization step. Typically, the person skilled in the art will be able to use for this step complete culture medium of the YPG type (containing 10 g/L yeast extract, Bactopeptone 20 g/L, glucose 20 g/L and demineralized water qsp 1 L).

The selection step for spores or segregants of interest achieved as described previously on the basis of at least one of the following 3 criteria:

The first criterion consists in evaluating the spore's capacity to induce the expression of MCM7 in the presence of organic acid. As already stated, this induction of expression can be evaluated by any technique known to the person skilled in the art at the level of either the transcription or the protein. It must be understood that this step consists in positively selecting the spores or segregants having this phenotype (induction of expression of MCM7 by an organic acid, advantageously acetic acid) i.e. in isolating spores having this phenotype for the next step.

The second criterion relies on the presence, at 5' of MCM7 of the spore, of a Haa1p binding site. Accordingly, and in a suitable manner, the region located upstream of MCM7 comprises the sequence (G/C)(A/C)GG(G/C)G, perhaps GNN(G/C)(A/C)(A/G)G(A/G/C)G (where N is a nucleotide chosen from A, C, G and T).

According to a specific embodiment, this region contains at least one sequence chosen from:
GAGGGG corresponding to the minimum Haa1p binding site;
GAGGAGGGG corresponding to the motif recognized by Haa1p, determined in silico;
The sequence SEQ ID NO: 2 or
The sequence SEQ ID NO: 3 or
The sequence SEQ ID NO: 4)
advantageously the sequence SEQ ID NO: 3 or 4.

These sequences can be demonstrated by any technique known to the person skilled in the art such as sequencing, PCR, hybridization.

According to another criterion, the spore has a base G at the position corresponding to the 624794 position of chromosome II, indicated in bold in the corresponding sequence in the minimum Haa1p binding site (GAGGGG). Note that an A is observed in this position in non-acetic-acid resistant spores. Without wanting to be bound by any category, the replacement of a base A by a base G allows the creation of a functional Haa1p binding site, allowing the expression or overexpression of MCM7 in response to acetic acid.

Note that other mutations can be found in this region, advantageously chosen from:
a T at the 624536 position;
a T at the 624732 position;
a G at the 624736 position;
a C at the 624758 position;
an A at the 624801 position;
an A at the 624832 position;
a C at the 625073 position;
a G at the 625146 position;
an A at the 625199 position.

According to a specific embodiment, a segregant targeted by the invention is selected because of the presence of at least one base G at the 624794 position of chromosome II, perhaps of at least one C at the 624758 position, a G at the 624794 position and an A at the 624801 position, perhaps even because of the 10 nucleotides mentioned above in relation with the specific positions stated.

The demonstration or identification of these mutations is easily achieved by the person of skill in the art, for example by sequencing the positions of interest.

A selection like this can for example be made on the basis of total or partial sequencing according to the techniques of molecular biology well known to the person of skill in the art, or by PCR techniques. The sequencing can accordingly be achieved by sequencing by hybridization or by high throughput sequencing techniques such as pyrosequencing, synthetic sequencing or ligation sequencing. Alternatively, the selection can be made on the basis of PCR techniques by looking for the targeted polymorphisms. In this context mention may be made of, for example, multiplex PCR techniques, which will look for several polymorphisms in a single test, nested PCR, which produces highly sensitive results, or colony PCR, which does not require DNA extraction.

To achieve the sequencing or PCR, a DNA multiplication step may be necessary, to have sufficient biological material available. It will then be possible to proceed with amplification by cultivating each strain or spore in a culture medium suitable for its reproduction. Further, a DNA extraction step for yeasts may be necessary, and can be done according to molecular biology methods well known in the field of the invention.

The method of the invention can be implemented in diverse ways: the yeast selection step can be done from parental strains, and/or from spores that come from it, and/or from strains obtained after hybridization. As already stated, it is however particularly advantageous to proceed with the selection step from spores coming from the parental strains.

Thus, according to one preferred embodiment, a method according to the invention comprises the following steps:
a) prepare segregants from a first parental strain and segregants from a second parental strain;
b) select from among the segregants of step a) those that can induce the expression of MCM7 in the presence of organic acid and/or having a Haa1p binding site in the sequence upstream of MCM7, advantageously the sequence SEQ ID NO: 3 or SEQ ID NO: 4, and/or having a base G at the 624794 position of chromosome II;
c) hybridize the segregants from the first parental strain and selected in step b) with segregants from the second parental strain, optionally selected in step b);
d) select among the hybrids from step c) those resistant to organic acid.

Step a) of the method corresponds to a preparation step for segregants from two different parental yeast strains, advantageously *S. cerevisiae*, i.e. a sporulation step. The person skilled in the art will easily be able to obtain segregants from parental strains defined above, according to the methods well known in the field of the invention.

In an advantageous embodiment, this step comprises the culture of the first parental yeast strain firstly and the second parental yeast strain secondly, in a medium deprived of nitrogen or sugar.

In a preferred manner, the parental strains used are yeast strains belonging to the *Saccharomyces* group, advantageously *Saccharomyces cerevisiae*.

According to a preferred embodiment, the first strain is chosen for its resistance capacity to organic acid, advantageously acetic acid, particularly during glucose fermentation. It may in particular be strain EGAc1 registered under the Budapest treaty with the CNCM under number I-4839 on Mar. 13, 2014. The segregants of this strain will as a priority be the subject of the selection step b) of the method.

According to another preferred embodiment, the second parental yeast strain is chosen for another phenotypic trait of interest, for example its capacity to metabolize xylose. It can for example be the strain registered under the Budapest treaty with the CNCM under number I-4538 on Oct. 5, 2011.

In a specific case, the second parental yeast may also have resistance capacity to organic acid, advantageously acetic acid, particularly during glucose fermentation. In that case, the spores of this strain will also be the subject of the selection step b) of the method.

Step b) of the method of the invention is used as described and allows the removal of spores that do not have the desired phenotypic trait, here resistance to an organic acid in the sense of the invention. Accordingly and thanks to this step, the probability of obtaining from the hybridization a strain having this phenotypic trait is greatly increased.

Step c) of the method of the invention is a step of hybridization of segregants from a first parental yeast strain with segregants from a second parental strain, where at least one of the segregant populations has been previously selected in step b), advantageously that from the first parental yeast strain.

Preferably, a mass hybridization is conducted in step c). In other words, step c) corresponds preferably to a hybridization step for all of the spores from step b).

Optional step d) of the method consists in selecting among the hybrids from step c) those capable of alcoholic fermentation and having a phenotype of resistance to organic acid, advantageously acetic acid. As already stated, this step is easily achieved by traditional selection methods, using usual culture techniques. This step is advantageously used on a medium comprising glucose.

The present invention is going to be illustrated more ahead using the following example embodiments, supported by the attached figures. However, they have no limiting scope.

LEGENDS FOR THE FIGURES

FIG. 1 shows the flow chart used to determine the proportion of alleles from EGAc1 (I-4839) in yeast populations that fermented in the presence of acetic acid (popB) or in yeast populations that fermented without acetic acid (popC) and along all of chromosome II.

S288c: strain of *S. cerevisiae* whose genome serves as GenBank reference GCA_000146045.2., version of Apr. 18, 2011; NCBI Gene ID: 852501; chromosome II: NCBI NC_001134.7)

EGAc1: strain registered under the Budapest treaty with the CNCM (Collection Nationale de Cultures de Microorganismes, Institut Pasteur, 25 rue du Doctor Roux, 75724 Paris Cedex 15) on Mar. 13, 2014, under number I-4839.

I-4538: strain registered under the Budapest treaty with the CNCM (Collection Nationale de Cultures de Microorganismes, Institut Pasteur, 25 rue du Docteur Roux, 75724 Paris Cedex 15) under number I-4749.

EGAc2: strain registered under the Budapest treaty with the CNCM (Collection Nationale de Cultures de Microorganismes, Institut Pasteur, 25 rue du Doctor Roux, 75724 Paris Cedex 15) on Mar. 13, 2014, under number I-4840.

(B) the LOD score value (similarity index) as a function of the position along chromosome II for the 3 series of experiments conducted.

Figure 4:
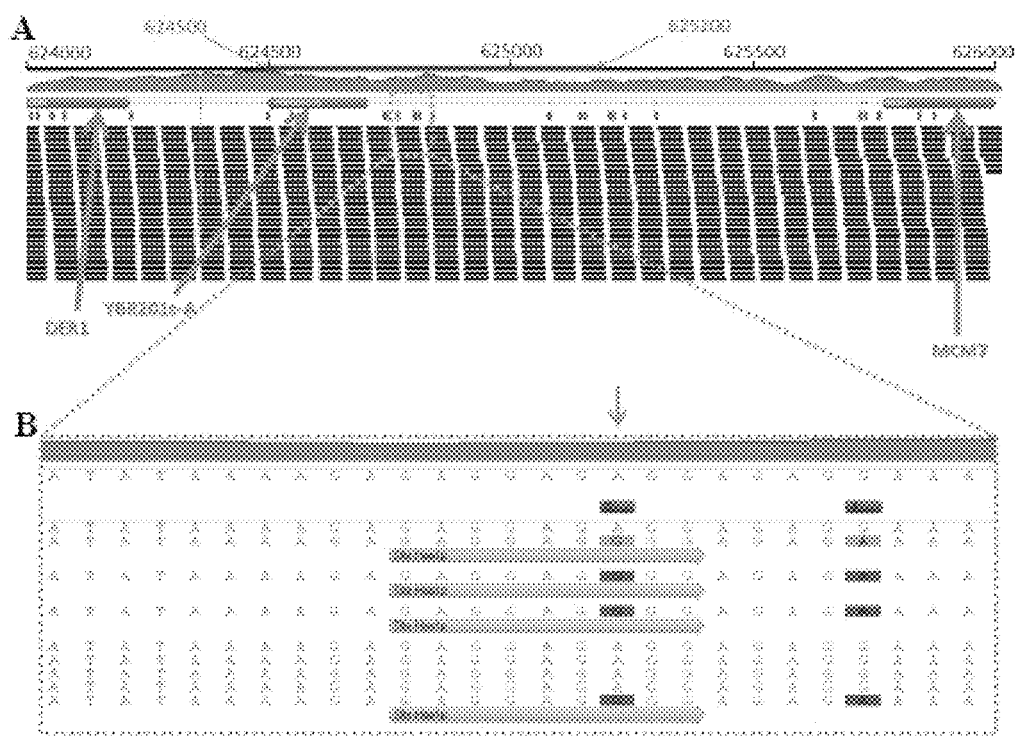

FIG. 4 corresponds to (A) a graphic representation of assembly of genome reads for strain EGAc2 (I-4840) in the 624000 to 626000 bp area of chromosome II of the reference strain. The area where the LOD scores are the highest is shown (624500 to 625200 bp; SEQ ID NO: 3).

(B) a focus on the impact of SNP (A>G) that affects 50% of the alleles in this strain in the 624794 position. The arrows represent the presence of a site recognized by the Haa1p transcription factor in the sequence SEQ ID NO: 2.

Figure 5:
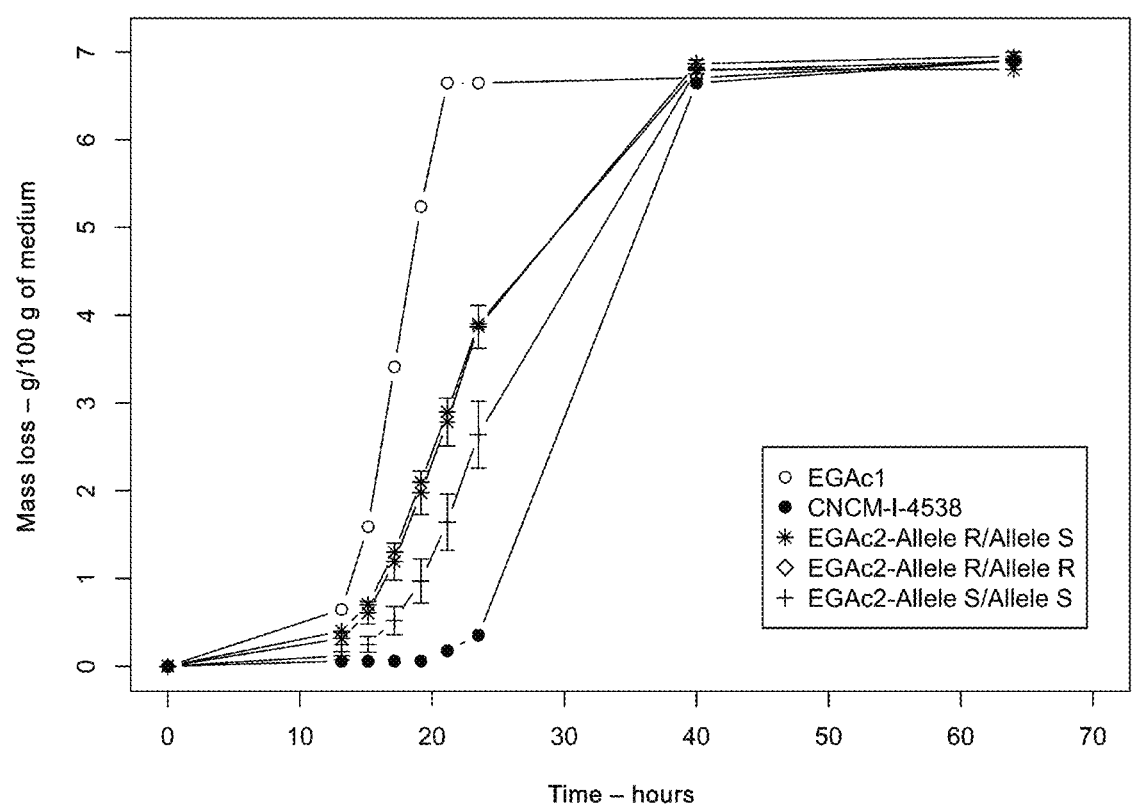

FIG. 5 relates the average change in mass loss during a fermentation on YFAc medium at 32° C. with an inoculum of 0.25 g/kg (dry matter eq.). The strains used are:
strain I-4538, sensitive to acetic acid (S);
strain EGAc1 (I-4839), acetic-acid resistant (R);
strain EGAc2 (I-4840) heterozygous, denoted "EGAc2-AlleleR/AlleleS";
strain EGAc2 (I-4840) made homozygous for the allele from EGAc1 (resistant allele) at locus II-624794, denoted "EGAc2-AlleleR/AlleleR";

strain EGAc2 (I-4840) made homozygous for the allele from I-4538 (sensitive allele) at locus II-624794, denoted "EGAc2-AlleleS/AlleleS".

The error bars correspond to standard deviations calculated on the basis of measurements made with the 7 homozygous strains for the resistant allele and the homozygous strains for the sensitive allele.

EXAMPLE EMBODIMENTS

Example 1: Identification of Genetic Traits and Mutations Related to the Phenotype of Resistance to Weak Organic Acids Such as Acetic Acid In these first experiments, the goal is to produce a diverse yeast population from a genetic point of view (a), so as not only to select the strains resistant to weak organic acids but also to be able to analyze the genetic traits involved in this phenotype (b).

a. Production of a Yeast Population Comprising Strains Resistant to Weak Organic Acids:

The yeast population was obtained by random recombination from mass sporulation and hybridization. This strategy is inspired by the work of Leo Parts et al. (2011, *Genome Res*, 21(7):1131-8). In brief, a segregant (also called spore) for an acetic-acid resistant strain (strain EGAc1/I-4839) is crossed with another segregant, from strain I-4538, thereby creating a first hybrid (strain EGAc2/I-4840), as described in WO2013/178915.

Secondly, the genome of strain EGAc2 (I-4840) was recombined randomly to obtain a very diverse yeast population from a genetic point of view. In practice, hybrid EGAc2 (I-4840) was set to sporulate then the spores obtained were left to freely rehybridize among themselves, as described in WO2013/178915. The cycle was reproduced 4 times, thereby generating a 24 reduction in the genetic distance in centiMorgan (cM).

b. Selection of Strains Resistant to Weak Organic Acids:

Strains resistant to weak organic acids were selected following the principles of population genetics, particularly the Hardy-Weinberg principle, which states that in an isolated population with unlimited count, not subject to selection, and in which there are no mutations, allele and genotype frequencies remain stable from generation to generation.

Accordingly, in the absence of selection, in the case of 2 alleles "A" and "B," where only "A" can play a role in adapting the population at a given selection pressure (for example resistance to weak organic acids), the frequencies of allele "A" and allele "B" in the population remain stable. By contrast, if the environment changes, and the medium is enriched with weak organic acid, then the less adapted strains will disappear (B) for the benefit of the more adapted strains (A). According to this principle, in the case where selection pressure exists, we then observe a deviation in this equilibrium over several generations. Accordingly, by comparing the allele frequency variations between a population not subjected to the selection and a population subjected to a selection pressure, one can determine the alleles that may be involved in the resistance or adaptation to the selection applied.

In practice, to have a control population, a sample of the population obtained in point a) was cultivated in a medium devoid of acetic acid (no selection pressure). The resulting population is called "population C."

In parallel, a sample of the population obtained in point a) was subjected to a high selection pressure by adding acetic acid at the start of the alcoholic fermentation in the presence of glucose. The resulting population is called "population B." In practice, acetic acid was added to the culture medium so as to obtain a concentration of 4 g/L.

c. Determination of Genetic Traits Involved in the Phenotype for Resistance to Weak Organic Acids:

Strain EGAc1 (I-4839) being acetic-acid resistant, it is expected that the genetic traits associated with this resistance are present in this strain. Consequently, to limit the number of alleles to analyze, one firstly identifies the alleles specific to strain EGAc1 (I-4839) that are present in strain EGAc2 (I-4840), and in populations C and B. Secondly, it is possible to determine the frequency of each of these alleles appearing in the stressed (B) or unstressed (C) populations.

The study of allele frequency variations along the genome was conducted in the following manner:

After the fermentations, the genomic DNA coming from strain EGAc1 (I-4839), from strain EGAc2 (I-4840) and from populations B and C were extracted then sequenced by the "Paired End" method using an Illumina HiS eq 2000.

Figure 1:
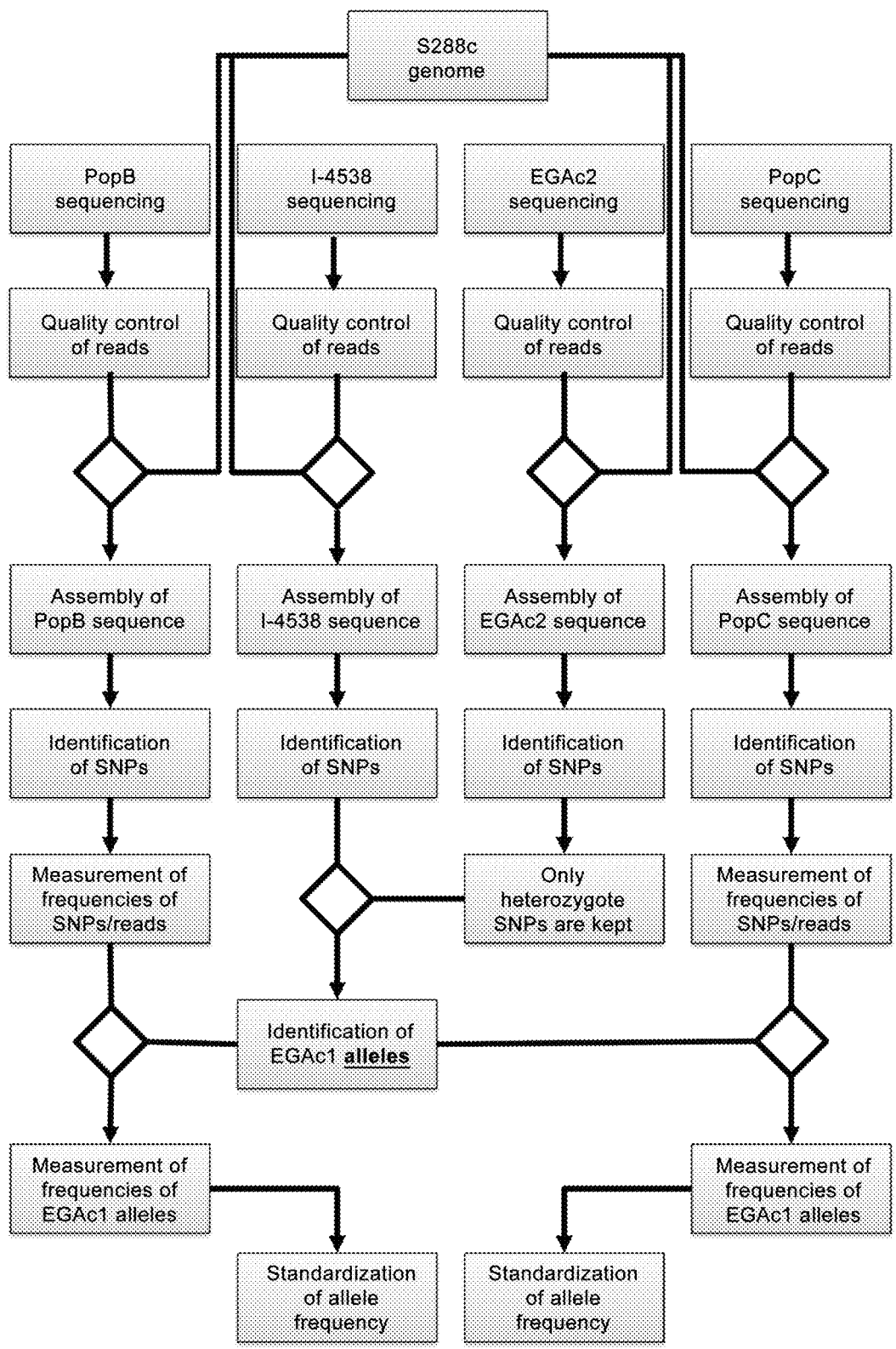

The results were then processed according to the approach illustrated in FIG. 1. Note that the reference genome is that for strain S288c (GenBank GCA_000146045.2., version of Apr. 18, 2011; NCBI Gene ID: 852501; NCBI NC_001134.7).

In the case of a study conducted on complex populations, the allele frequency reflects the number of individuals carrying the allele in question. So as an example and in direct application of the Hardy-Weinberg principle, if an allele is present with a frequency of 70%, it is possible to deduce that 91% of individuals in the population carry at least one copy of this allele.

Figure 2:
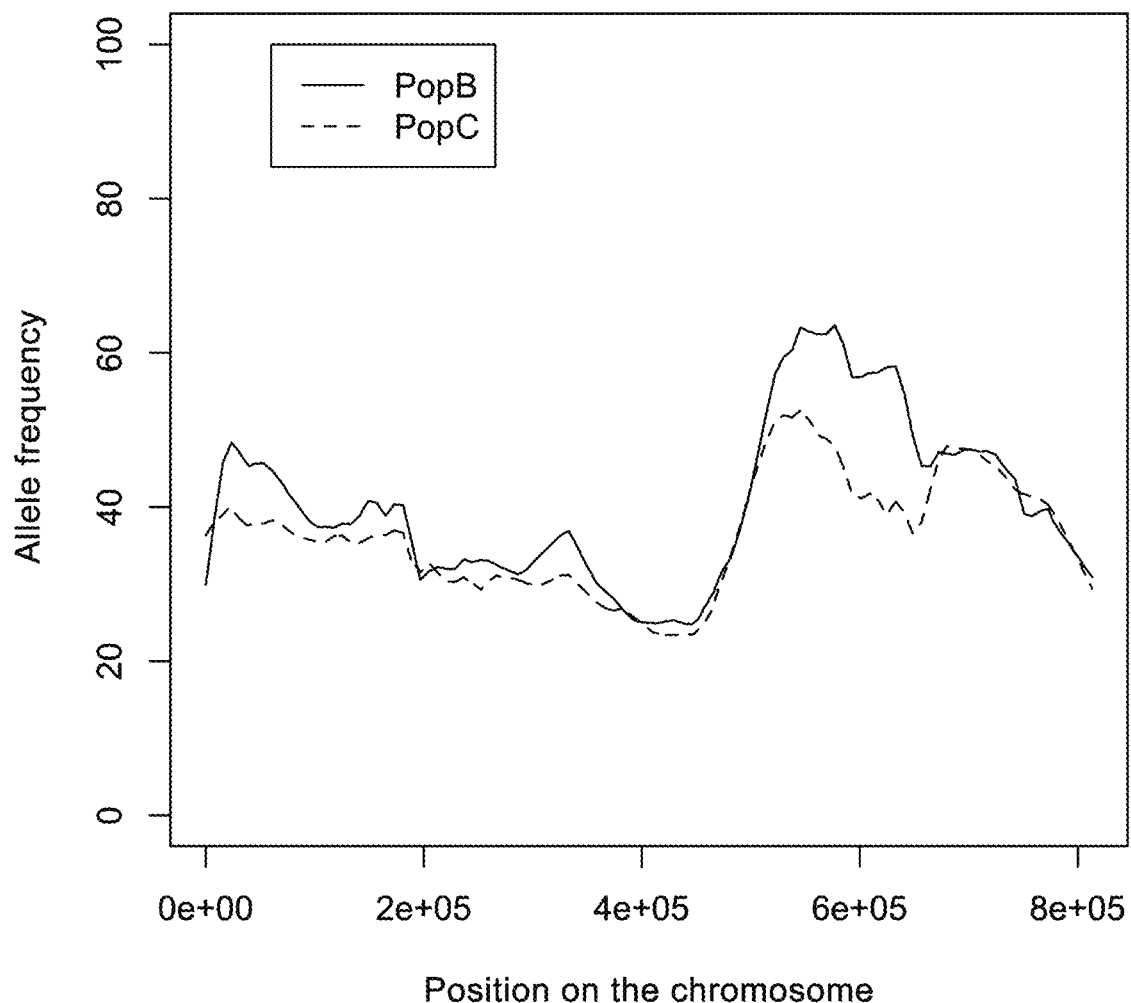
FIG. 2 shows the frequency averages for alleles in strain EGAc1 (I-4839) in both populations: PopC=not stressed, dotted; PopB=stressed, line

FIG. 2 shows how the allele frequency from strain EGAc1 (I-4839) changes along chromosome II and present in populations B and C.

The results in FIG. 2 show that in the first portion of chromosome II, the allele frequencies from EGAc1 (I-4839) are very close in both types of populations and up to about 530 kb. This observation suggests that the genes present in this part of chromosome II (from 0 to 530 kb) would not be involved in the acetic-acid resistance process transmitted by the segregant from strain EGAc1 (I-4839) to strain EGAc2 (I-4840).

The second part of chromosome II (from 530 kb to 660 kb) shows a dissociation in curves corresponding to allele frequencies from EGAc1 (I-4839) in both types of populations. This result shows that there is an allele that is more represented in the populations subjected to selection pressure than in those that fermented without this pressure. This overrepresentation suggests that this allele from EGAc1 (I-4839) would favor the multiplication of cells in the presence of acetic acid. In other words, the second part of chromosome II (from 530 kb to 660 kb) is identified as being a quantifiable genetic trait (also called QTL), i.e. a genetic region involved in acetic-acid resistance.

QTL are generally large sequences. One sub-region seems to stand out: this is the region from bases 624000 to 626000 of chromosome II. This region seems to include the highest allele frequency variations. Next, it is this sub-region that was analyzed.

d. Analysis of Genetic Traits Involved in the Phenotype for Resistance to Weak Organic Acids:

Within the QTL, these are more specifically frequency variations for punctual polymorphisms (SNP for "Single-Nucleotide Polymorphism"), in comparison with the strains that do not present the phenotypic trait studied, which can be the most relevant.

The base pair region 624000 to 626000 of chromosome II was therefore analyzed in more detail. The similarity index values for the SNPs that it comprises were analyzed to target the region comprising the most relevant SNPs in the phenotype for resistance to weak organic acids (i). Once this region was identified, the SNPs that it comprises were analyzed more deeply (ii).

i. Determination of the Most Region the Plus Pertinente:

The approach chosen was that of LOD scores, as described by Lander and Botstein (1989, *Genetics*, 121:185-99).

The first step consists in determining the inference:

$$fB = \frac{n1,B}{n1,B + n2,B}$$

$$fC = \frac{n1,C}{n1,C + n2,C}$$

In the first equation, "n1" is the number of reads bearing the SNP from strain EGAc1 (I-4839) in population B and "n2" the number of reads bearing the other SNP. The next equation relates to the same calculation but applied to the results of unstressed populations.

The second step consists in calculating the similarity:

The similarity (L) is defined as being a conditional probability function. Accordingly, this is the probability of having the allele of strain EGAc1 (I-4839), either in the population that fermented in the presence of acetic acid, or in the population that did not ferment in the presence of acetic acid, calculated according to the equations below:

$$\mathcal{L}_{(B|fB)} = \Pi_{i=1}^{3}(B_i|fB)$$

$$\mathcal{L}_{(C|fC)} = \Pi_{i=1}^{3}(C_i|fC)$$

The third step consists in calculating the LOD score:

From these determinations of similarity for each allele, it is now possible to calculate the LOD for each SNP and to combine it with the allele from strain EGAc1. The equation used is that published by Lander and Botstein in 1989:

$$LOD = \log\left(\frac{L(B \mid fB) \cdot L(C \mid fC)}{L(B \cup C \mid f)}\right)$$

Figure 3:
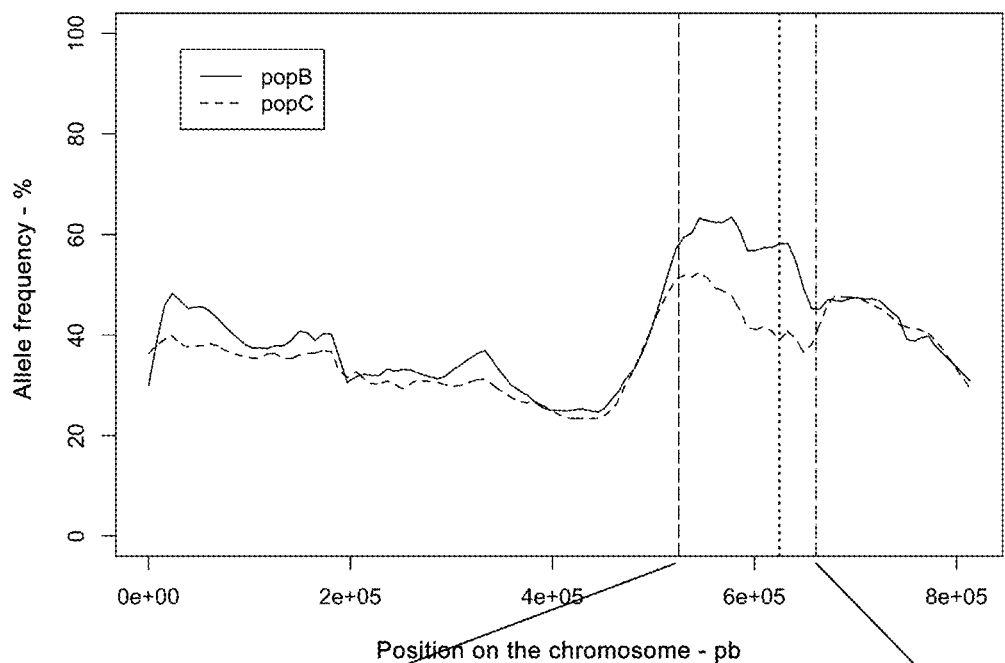
FIG. 3 shows (A) the frequency averages for alleles in strain EGAc1 (I-4839) in the yeast populations that fermented in the presence of acetic acid (popB: stressed, line) or in the yeast populations that fermented without acetic acid (popC: not stressed, dotted) and along all of chromosome II.
Figure 3:
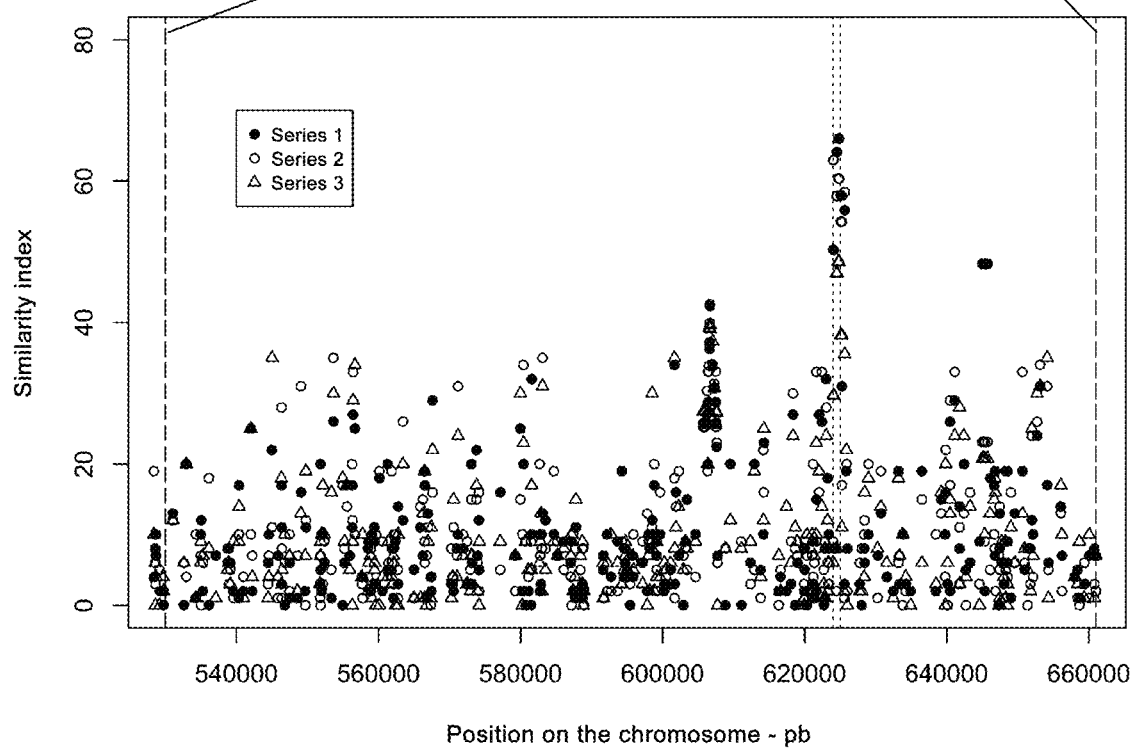

The LOD score was analyzed 3 times on the area of interest for chromosome II (3 independent experiments). These results are shown in FIG. 3. These results show that when the difference in allele frequency is high, the dispersion of LOD scores is also high (principally because of their mathematical and biological links).

FIG. 3B shows that an area comprised between 624500 bp and 625200 bp has high LOD scores that appear reproducible. The most relevant region identified is therefore the area between 624500 bp and 625200 bp of chromosome II (SEQ ID NO: 3).

ii. Analysis of SNPs in the Most Relevant Region (Between 624500 bp and 625200 bp of Chromosome II):

The genetic structures present and the SNPs found most frequently in the area considered (between 624500 bp and 625200 bp of chromosome II) in strain EGAc2 (I-4840) were analyzed.

These results are shown in FIG. 4.

10 SNPs were identified in the area between 624500 bp and 625200 bp (SEQ ID NO: 3) of chromosome II:

| Position (with reference to strain S288c: NC_001134.7; SEQ ID NO: 1) | Base in the reference strain | Mutation |
| --- | --- | --- |
| 624536 | A | T |
| 624732 | C | T |
| 624736 | A | G |
| 624758 | T | C |
| 624794 | A | G |
| 624801 | G | A |
| 624832 | C | A |
| 625073 | T | C |
| 625146 | C | G |
| 625199 | C | A |

The impact of these SNPs on the sequence of coding areas (open reading frames) did not show mutations causing changes to the protein sequence.

By contrast, polymorphism (A→G) in the 624794 position, which affects 50% of the alleles in strain EGAc2 (I-4840), reconstitutes a site recognized by the Haa1p transcription factor located upstream of MCM7, and codes a DNA helicase. DNA helicases replicate DNA and therefore regulate the cell cycle progression and, consequently, the production of biomass. In other words, yeasts having this SNP have a binding site for Haa1p transcription factor that the other yeasts do not have, upstream of a gene known to play an important role in cellular division. Accordingly, the fact that the presence of a site recognized Haa1p upstream of MCM7 makes the strains more resistant could hold to the fact that in the presence of acetic acid, yeasts carrying this site would multiply more quickly.

Example 2: Validation of the Interest of the Allele Denoted "EGAc1-II-624794"

To take another approach to analyzing the identified area of interest (particularly bearing mutations T→C in the 624758 position, A→G in the 624794 position and G→A in the 624801 position; SEQ ID NO: 4), it was chosen to achieve the loss of heterozygosity in strain EGAc2 (I-4840). Secondly, the performances of strains made homozygous for one or other of the two alleles were compared.

a) Construction of Homozygous EGAc2 Strains for the Wild Allele or for the Allele Comprising the SNP Identified as of Interest:

Strain EGAc2 (I-4840) is heterozygous for the QTL identified as of interest, i.e. bearing the SNP (A→G) in the 624794 position. Indeed, it has an allele denoted "II-624794" of strain EGAc1/I-4839 (i.e. having a G in the 624794 position) and an allele "I4538-II-624794" from strain I-4538 (i.e. having an A in the 624794 position). As a reminder, strain EGAc1 (I-4839) is acetic-acid resistant whereas strain I-4538 is not.

To better study the role of this mutation, homozygous strains either for allele II-624794 of strain EGAc1 (denoted "EGAc1-II-624794") or for allele II-624794 of strain I-4538 (denoted "I4538-II-624794") were prepared. To do this, a cassette called LOH was used. In its principle, the cassette LOH is constituted of a gene (KanMX4) conferring resistance to geneticin to yeasts that express it. Another part of the cassette carries the sequence GIN11m86. The latter is toxic for cells that express it (Akada et al., 1997, *Mol Gen Genet* 254, 267-74; Kawahata et al., 1999, *Yeast*, 15, 1-10 and Akada et al., 2002, *Yeast*, 19, 393-402). This system is qualified as dominant negative because a single copy of this sequence is necessary to confer the lethal genotype on the cells. In so far as the sequence GIN11m86 is placed under the dependence of promoter GAL2, it is possible to select on YNB+Galactose the cells that would have lost the cassette.

The strategy used to build homozygous EGAc2 strains for allele II-624794 is as follows:

The LOH cassette was flanked by recombinogenic sequences capable of deleting one of the two alleles. The selection of transformants is conducted on a YNB-G418 medium (containing geneticin). To determine which of the two alleles was kept, the locus was amplified by PCR using seeds, called validation seeds, outside the LOH cassette. The smallest of the resulting PCR fragments (650 bp) was cloned in a plasmid pTOPO then sequenced, from which it was determined which of the two alleles was kept. The strains were retransformed with a sequence identical to the allele kept. The new transformants were selected on a YNB medium containing galactose as only carbon source, allowing the selection of those that lost the LOH cassette. Finally, using validation seeds, PCR was again done. The product of this reaction is unique and was directly sequenced.

Using this strategy, 7 homozygous EGAc2 strains for allele "EGAc1-II-624794" (conferring resistance to acetic acid), denoted "EGAc2-AlleleR/AlleleR", and 5 homozygous EGAc2 strains for the allele denoted "I4538-II-624794" (conferring sensitivity to acetic acid), denoted "EGAc2-AlleleS/AlleleS", were built and validated.

b) Analysis of the Impact of Homozygosity on Resistance to Acetic Acid:

After having obtained the 12 previously cited homozygous strains, their capacity to ferment glucose in the presence of acetic acid was tested. These performances were measured on a YFAc medium (4000 ppm; pH 4.4), defined as follows:

| | |
| --- | --- |
| Glucose | 150 g/kg |
| EXL type J100 (Yeast extract) | 5 g/kg |
| DAP (Diammonium phosphate) | 4.7 g/kg |
| Citric acid | 11.4 g/kg |
| Na citrate (sodium citrate) | 13.5 g/kg |
| Acetic acid | 4 g/kg |
| Tween 80 | 1 mL/kg |
| $ZnSO_4$ 10.6 g/L; | 2 mL/kg |
| $MgSO_4$ $7H_2O$ 400 g/L; | 2.5 mL/kg |
| Thiamine 18.24 g/L; | 1 mL/kg |
| Pyridoxine 5.28 g/L; | 1 mL/kg |
| Biotin (1.76 g/L) + KOH | 1 mL/kg |
| Pantothenate (3.8 g/L) | 1 mL/kg |
| Niacin (8 g/L) | 2.5 mL/kg |
| Myo-inositol (50 g/L) | 1 mL/kg |
| Riboflavin (1 g/L) | 1 mL/kg |
| para-Aminobenzoate (1.2 g/L) | 1 mL/kg |

The mass loss results observed during the fermentation on this medium are shown in FIG. 5. The curves shown are the averages of the values obtained for all strains in the same genotype.

The results presented in FIG. 5 show that strains EGAc2 made homozygous for the sensitive allele (S) at locus II-624794 have a delay initiation in fermentation by more than EGAc2 strain (I-4840) on YFAc. This shows that the loss of allele "EGAc1-II-624794" in a strain EGAc2 for the benefit of a homozygosity of allele "I4538-II-624794" makes the strains obtained more sensitive to acetic acid during the glucose fermentation.

By contrast, the EGAc2 strains made homozygous for allele "EGAc1-II-624794" at locus II-624794 have fermentation kinetics on this medium that is not different than that of EGAc2 strain (I-4840). This result suggests that the homozygosity does not add anything to the strains in this medium.

In conclusion, this work reveals that the allele "EGAc1-II-624794" does indeed contribute to resistance to strain EGAc2 (I-4840) regarding acetic acid. However, a single copy seems to be sufficient to confer a resistance phenotype on acetic acid.

SEQUENCE LISTING (4 sequences)

SEQ ID NO: 1 - DNA, 813176 bp, Artificial Sequence
  Synthetic Polynucleotide
  misc_feature: NCBI NC_001134.7
aaatagccctcatgtacgtctcctccaagccctgttgtctcttacccggatgttcaaccaaaagctacttactacctttattttatgtttactttttataggttgtctttttatcccacttcttcgcacttgtctctcgctactgccgtgcaacaaacactaaatcaaaacaatgaaatactactacatcaaaacgcattttccctagaaaaaaaattttcttacaatatactatactacacaatacataatcactgactttcgtaacaacaatttccttcactctccaacttctctgctcgaatctctacatagtaatattatatcaaatctaccgtctggaacatcatcgctatccagctctttgtgaaccgctaccatcagcatgtacagtggtaccctcgtgttatctgcagcgagaacttcaacgtttgccaaatcaagccaatgtggtaacaaccacatctccgaaatctgctccaaaagatattccagtttctgccgaaatgttttattgtagaacagccctatcagcatcgacaggaatgccgtccaatgcggcactttagatggggtaactcccagcgcaagctgatctcgcaagtgcattcctagacttaattcatatctgctcctcaactgtcgatgatgcctgctaaactgcagcttgacgtactgcggaccctgcagtccagcgctcgtcatggaacgcaaacgctgaaaaactccaactttctcgagcgcttccacaaagaccgtatcgtcttttgcctcccattcttcccggcactttttttcgtcccagttcaaaaagtactgcagcacctctgtcttcgattcacgcaagttgctccatactttataatacaactctttgatctgccttccagacatgcggaaaacttggctcccttgcttgcctcttgtcgaatccaatacactaattgtttctcttcttctagtaatggccaggtaccaagcataatttctctgtatctgagagtagatctctctcctttttacgctaaaatatttcaaatatcctacagggtccccatgatatggctcgatgtcttccaagtattctttgtattcctcatcatttcgcagcattctctccacagctagtgcttcccaagctatcctccgatacgatactttctggccagcccaacagacacagagcccgaacatcttttgacagcccttgcataatccgtattgtgtgaatactccctctgggcagaagtatatgtcaataccatagaggaaaagatgtttaatttcgtcagaccgaaatccaagaaactgtaagacattcatattctcggaagtattgggaaattgtgctttcagtttctttctctctaggaaaaccatttgactccctttccgcttatacgactctttgttaatgtcggtgactggatggaatctattatcctcagcattgccatctttattggcgtcctccttggcactagcgttggtactttcagtggtagtggcattagtgctggagttggtgctagcagtggtagtggcattagtgctggagttggtgctagcagtggtagtagcactagtgttggagtcggtactttcggtggtagtagcactagtgttggagttggtactttcagtggtagtcgcactagtcctgacgttgatgctagcagtggtagtagcattagtgttggagtcggtactttcggtggtagtagcactagtgttggagttggtactttcagtggtagtagcattagtgctagagttgatactttcagtggtagtagcactagtcctgacgttgatgctggcagtggtagtagcactagtcctgacgttggtgctggcagtggtagtagcactagtcctgacgttggtgctggcagtggtagtagcattagtgctggagttggtagtcgcattggtagtagcactagtcctgacgttggtgctggcagtggtagtagcattagtgctggagttggtagtcgcattggtactggcattagtgttggagttggtactttcagtggtagtcgcactagtcctgacgttgatgctggcagtggtagtagcattagtgctggagttggtactttcagtggtagtcgcactagtcctgacgttgatgctggcagtggtagtagcattagtgctggagttggtactttcagtggtagtcgcactagtcctgacgttgatgctggcagtggtagtagcattagtgctggagttggtactttcagtggtagtagcattagtgttggagttggtactttcagtggtagtcgcactagtcctgacgttgatgctggcagtggtagtcgcactagtcctgacgttgatgctggcagtggtagtagcattagtgctggagttggtagtcgcattggtactggcattagcactaccatgaatgcacgtgtcgctgtcctcatcactgctgcaatactttctgcacctgtcactgctattgctctcctggaagctagacggtaacgcaacgatcgacatggaagctgtcgcctgattttcagccaatctgtccattctttctatcagttccactgtgtcagcagacaggtctgtcctggagccacagcatccaacatgctggccctttttttcctttctttgattcaagtccatagaactcgcgtacctgttcggttatacagccttccttaatcggtggtaattcacccttacgattccttgccgcccaactgttttttctagataatagataacagaggcccccatctcttagtctccctacgccttgaatgagctcaataatattaagtctattatcaagcatgatcaccatcatcaattgcttaatgtcaattccttcagtcactaatttcgttccgatgagaacttgcatgctaccgtcagtgacaaactcctttgtgcgagacaccttttctgcagcacccaagcttcccgtgtatccataccaccctaaaatactttctccaagagcaggccaattcttccacttcgttggttgtgcttgcaactacaatggccttcgactctggttcaatttcaaagagggctaaaagaagcttcagtgcttcttcgggctgtgattccactttcttccaaattttatgaacatgccctaaaggcacctcggatttctccttgattagattaaacatccgtgttggatagctggatagacctctgctgagatcttccgaccgtttgagctcgttgatgtccatcgacttcttggccagtcccgtaagcccaatacgctgcaacgcagcatcagcaacagcctcaggggctgtgccgctcaaaaagattgctttctcaaaagcgtcaaaatcaaggttagttatgcccccaaattgcgactgccggtagacctccgtttcaaagttgtgaaactcatctacaatgaggtaacccaattttacgttgttggtcctaaaggtgcactcaacaatattctcccacgcagctatcctgtctgtgaaattagtgctagcaagatcatcgtagatccccacgtataaatcagtaacgccatcgcaaccttcttcaataaagtttcttacaggggccacattcaagcaaccgcgtcggcccaacctgatcatgcaattagcaagcaacactgtgtacggtacaaacagaaacgacacatatttcacgtcgcccttagatgccagtgctatcaaggggagatgaaataactccgtcttaccatagcccggtggggcctgtactgccacagagggtgtgtctgccatgtatatttcatgacataagcgcaactgatgcaagtccctgaattcaaaggagctgccaaagagtttccggcctgcgacgaggatatcgtttgtactcttgggctctcggggcctttttcgcgttactcttgaaattttttgatcatgatctgaactcgccgcctcacctgccactacgtcttccgcattccgagtactagagaatgaacaatggtagtcgctttcaaggcctaaccattgaatccagcgctcggaagtgagtccgtcaagcgtctttagtcgaggctccgatgaaccgttcttgttgtatcgtcgacgtatacgttgcgctgtagctctggataacggtaagcgtatcaccgtaagctcgtcaattatttttgagagccgcggtcattttgttagtatctcttctcaacttgggcagcacacatgcaaaacatcacccaatcggtcctttttgttcatcatatcgttacatatctgtgaaaagtactttatctcagtgggtttacgtgggcatagatcacgcttcagccgctctgtgtcgactttcttttcgccaggtaaacttgcttggtatgcagaaaaaatcgatagctcatctacgtgtagtaacaagaacatgtagggtgccaaattgtatccatatttccttatggtgcttttctgaagactccttacaataggtgtgccagaaacaaagtcagtgaaagtacgcatcgtagagctgtcgttcggcctggcactcgctatttcgtaacaacgttccaggacacggaaactcaactcattatagtatcctctgttgaggtaaaaaagagaaagggtatcgtaatcctttctattgaatttcaaagtatgcacttgaaacaacgtgtagaccatcaagttgattttcttgggaataagatactttgaagggattggtccgccctggaaatctggttcgtcttcaacaaacgtcaggaacttttgtacatttttcccgaccatgacggaaacgacaattttttcaaaagaccttttcctatccattgcaccagttctgaattttaccactttgattagaccagacttttcgtcttcgtagaatgaccgcacttccgtggggatcgattcaaataaagttattgagggacaatgtaccaagtcgtttttgttatttagagccgactcaaactcgtcaaagtttgctttttcaaacttacgcctatcggaaactttcattttatttttgtaagtttcgaaattaacaatagtatgttgattgctatgctttttgacaagaaatccatcaatataaacaaaagattgtccagtttccgtcttatcatcatctaagaatgtaataattaagctactctattgagaagaagcagaatctgcgctatgcaggtgcaaatctccagcagcagcaaagaaaattcagttaataagaaatctcactaagataagcgactgtctgtccccttcaagcacaacatagaaaacagaaggatgtctcattcatcgcttgatttccggcctgcaaaaataaagtagtcggtacgtactttcgttttcaatttccatggtgcacagtatcttaactatctgcttagtcgaggagaaccaggattctgttcgttgctcagccgcttcgtggatattctcttggatactttaaacatggacctacgttccgctctcgaaaagaccaatataataaaaagttataaattacatttccttattaggtatacgacctcgcgcttcgaagtagaggagccctttttggcgtacctacatatggcgcgtcagacagacaaacttcccccaaaaatgtattaccccgccgaataagaaaacagacccattcacccacgacgtatcaagttacttccttggtgcaatgtcccactataaaaaaattccttgacgctagatcgttggactaaaatctgcgtcacaatcgcctaaacaggaaatattgcctattttcgtacaaggttacttcctagatgctatatgtccctacggccttgtctaacaccatccagcatgcaatacagtgacatatatatataccctaacactaccctaaccctaccctatttcaacccttccaacctgtctctcaacttaccctcacattaccctacctctccacttgttaccctgtcccattcaaccataccactcccaaccaccatccatccctctacttactaccaccaatcaaccgtccaccataaccgttaccctccaattagccatattcaacttcactaccacttaccctgccattactctaccatccaccatctgctactcaccatactgttgttctaccctccatattgaaacgttaacaaatgatcgtaaataatacacatatacttaccctaccactttataccaccacacatcacatgccatactcaccttcacttgtatactgatatgccatacgcacacggatgctacagtatataccactctcaaacttaccctactctcacattctactccactccatgacccatctctcactaaatcagtactaaatgcacccacatcattatgcacggcacttgcctcagcggtctataccctgagccatttacccataactcccacgattatccacattttaatatctatatctcattcggcgggcccaaatattgtataactgctcttaatacatacgttataccacttttgcaccatatactaaccactcaaattatatacacttatgccaatataaccaaaaaattaccactaaaatcacctaaacataaaaattatttatctttcaactttacgaaataaacacactcaattgcgtatctataccaccatgacgtcattaacgtaaaagttccttaatattaccatttgcttgaacggataccatttcagaatatttctaactttcacagaccatacattagaataatatgccacctcactgtcgtaacactctatattcaccgagaaacaatacggtagtggctcaaactcatgccggtgctatgatacaattgtatcctatttccattctcatatgctatccgcaatatcctaaaagcataactgatgcatctttaatcttgtatgtgacactactcatacgaagagactatatctaaagaagacgatacagtgatatgtacgttgtttttgtagaattataatgaaacgtcaaataaccctactatattataacttatcagcgccgtatactaaaacggacgttacgatattgtctcacttcatcttaccaccctctatcttattgttgataaaacactaacccctcagctttatttctagttacagttacaacaaactatcccaaaccataaatcttaatattttaggtgtcaaaaaatgaggatctccaaatgagagtttggtaccatgacttgtaactccactaccctgatctgcaatcttgttcttagaagtgacgcatactctatatggcccgacgcgacgcgccaaaaaatgaaaaaagaagcagcgactcatttttatggaaggacaaagtgctgcgaagtcatacgcttccaatttcattattgtttattggacatactctgttagctttattaccgtccacgctttttctacaatagtgtaaaagtttctttcttatgttcatcgtattcataaaatgcttcacgaacaccgtcattgatcaaataggtttataatattaatatacatttatataatcggcggtatttatatcatcaaaaaaagtagttttttattttattttttcattacttttcactgtctatggattttcattcgtaaaggcatcactccctagtttgcgatagtgtagataccgtccttggatagagcactggagatggctggctttaatctgctggagtaccatggaacaccggtgatcattctggtcacttggtctggggcaataccagtcaacatggtggtgaagtcaccgtagttgaaaacggcttcagcaacttcgactgggtaggtttcagttgggtgggcggcttggaacatgtagtattgggccaagtgagctctgatatcagagacgtagacacccaattccaccaagttgactctttcgtcagattgagctagagtggtggttgcagaaagcagtagcagcgatggcagcgacaccagcagcgattgaagttaatttgaccattgtatttgttttgtttgttagtgctgatgtaatcttaacaagaaatagtgaaatgaaagcgcatacctcaaaggcatatagttgaagcagctctatttatacccgttcctccatctgtcatcactacttaaacgattcgttaacagacgctcatttagcacctcacatattctccatatctcatctttcacacaatctcattatctctatggagatgctcttgtttctgaacgaatcatacatctttcataggtttcgtatgtggagtattgttttatggcactcatgtgtattcgtatgcgcagaatgtgggaatgcctattataggggtgccggggggtgccttgaaaaacccttttgcgcgcctgttaagtttccgttttcagtcaaaaagaatatccgaattttagatttggaccctcgttcagaagcttactgtctaagccatcatttggtgtgtcctaaacggtttccatgcaaagcaacatctttgttactcattcctgaaggttgaataaaaaatagcaaccatgtgcagggagtcgtatattgttagattctagagacttgtacgcatcatcaaagctgtaaatagaataaacatacgcaaggcgtcaaaagtgcatagttaagaaaattcctgacatgtgaaaatatgtgtttatgaaatgtgtcaaggcccgtctatagcgtagttaacccctctgcaggagtaagtgactttttttacgctcaaaaggcaacgagggcacatacttaaaagtcattttcaaacacatctgcagtttgcaacgacagataacaatattatgataggatggtatgatgttattagctgccacatattttttaacatagcattagtcacgtctcttcaattgttgggatgaaactctaaaatatcattcctttagtagtattccagttaccagtatattatcacatgccgaaaaagaagatgacataaagatcgacaaacagtcttcaaatataatggaagctggaatgcaaggattgataatgtaacaggatactgaatgacaaagtataaatgaaaaaaaaaaaaaaaaaaaagtagtaatactattatgtggaaataccgattccattttgaggattccaattgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattgcagattcccttttatggattcctaaatcctggaggagaacttctagtatatctacatacctaatattatagccttaatcacaatggaatcccaacaattacatcaaaatccacattctctacaccaataccatcgacgagagcttctagtaaattgtatacataacagtataacccttaccaacaatggaatctcaaagattattaaattattcacagactctgaggattcgggtaaaatagggtatttaactggttaccggaaaggtttagaaaattcgtggagggttggccgagtggtctaaggcggcagacttaagatctgttggacggttgtccgcgcgagttcgaacctcgcatccttcagtattttttttgatgatttaacgtactattaactagaataatagggaaatgcaattgcagtttgagaagaagaattattaataagccaaaaagcggctcactaagtaagtttttcttcatggcgtcctttgcatccagcaataatggttttagcaaaaaaatctctttcactacacaagttggagcatattttttaacaaatacagataaacgaaaggcgataataagtatacttcctatgtacaagaatctttaagtgatataatctttcagcggactagaagaatagggcgttcaactgttgtccttgcagaattgcgtaaactccttcaagtagtcattattttgctcgcagttttgccttaaaatgccctctgttgtagaagttaaaatttgttctatttttctattatttgccacccactctgtcaccttcgtccaatccttatattgagcttcctgtttctccgctctttctcttgcagcgtaaggatcaattcttgcgtctataagtggttccgcagtagtctttttattattaccgcactgctgatcggtctcgttcttcatctctgctgcctctttttcgcaaaatgaaattatattattccgtatttgccagttcggatatagttcttgcttcaaaaattccttacacttattttttccattaatagagcctttcctatagttgtttaatttttgtcttattatatcatcacttccatgccttagaaacctcaaaaatgaatctatcaagcttggatcaacacatctttctcgcgtaactgtgattgtagtaagtgacggttcatcattcggaaaagtaagatttgtttcaagtaagctttggggtgccgtaaacgtacgcctattatcaaccataccgtctttttgtctacgtgtataaatgagaagttttttttctaactatatccaagtttttcaaactacccaaaggatatttaacttggcggacaaaattaccgtcacgttcaaaagtgaatatataggcgattctgggtaacaagcaaaagtaaactacaatatggaatagtgtaaaacttcacttatcaacaacaaaatcgcttcaagcctcctatcttagagtctagagcctgataaaattcttatgcgagcaagggcaacctgatcgaattttataaaaactatttatggactaaaaacctacagcgctcttcatcatatcccttcccgtttcttccattgcgtcattcatggtttgtcccattgtggttgcatagtcattaatagtggtttctaccgtgtctaaacgagtttcaattgccctagaaacacttttaaggacaccatatccattacttcttccagagcttcttacaggtctggcatacctgtgatctttcgtaccgggaggtaactttctggctgcattactactactggaagatatgcatcctcgagcaattgcgctttcctcatacttcgattcgggcctttctataccgcccagtagctcatcaagttgatatggtgtgcaataaatagttcctctagcccattgtaaggaattcacttgaggcctataaccaatctttaaatcaggattgtacaaggtatcaataggagtatgttgtgatatgtcagcagtatgattcgaaccggtggcactttcattaagtactgaaatcaaagaagcttggaatttccctgtgcgaatgacaatgtcaacattttctaatatagatgaattttcaacgtattgagcgcttagagggaccgggcagcgtagatttttgacttccttaagctcaggtactgtcaaaactttaatatctccattaattagcaaaacgatcataatagttgaaagctttctttctcctttaccgtcaataatgggaataaatgataatccactagtggcaattggatacttgaaaagcgcatgagtgtccttagatttacctggtgatactaaacgaatgtcatttgcgccactgatagtaacaaatccaggtattgcgatacccttgcttaaaccctgcatctttgatatagtagcagaacaactgtagccagtatctttggcaaaagaatttattcctagaatttttccttgattgttggtctttgttgcatcagtgaatttaacctcaaatcttccattagttgcaggcagtattttgaaagtcatcaattccccgatatccgttccacatagcatcaaaatactagagaacccatcatctccatattccatgacgcaaaagtgaacggttgaaacgtaagagctaccagctttagaaatgaccctaatattttcattgaagattatagccgggcctcttctgtccaatattattaaggttccttcaatgaaaccaacggcaacgaacccgatattactattcatgattgcggacaccgcaccttttttagcatgtattaccgtacttggtataaagccttgtttaacgttcgtaggccctctatccgaaacatcaactaaaatagtttttgaatcatccaatgaaaatctgctaaacttcaattgcagtgcatcgcttttgggaagttgtccgtaaaacttgtttgtttcgaatttgaaaagaataacatccccaacctcagatgataccgccaattccaatgtttccgatgcaaaggagatattttttatggccaggttagtagctctgttaagtactttagcagtattcacttcaaatacagcgttgtcagttacttcactgtgtgaagcatcccatattctgactgaaccattactatgcccagttagtaaagcagatctggtctcatgccttctaatatttctggtggcaggaataccaccttttaaaaacgattcactttgagcgattgtcatcatccccagccaaagatttttttgaactgattgcgctatacaagtagtaaccgttggtcgaacccatgctaagctccgagggaaaatggaggccttggaactaaaagagcctgctgggtatatcaatgtttcaagttcgccatcttctaaaagtaataaaatgaggtttgtgtcatggcatccaccaaaatatggagaagccttcggcaagggtagaaaatttattagtggagctttgccaatcaacgaaaatagtttttgttgaaccggtttagcatagtacttgctcattgcgtcaaatgatgtcacagaatacattggtgtgccgcctaagtcaatcatggttatttcctgaggtaaacagggattttctgtagcttttgttgcaatcaacaacgatgtatactcaggattacgctggcaaagccagcttactttaaagatagcgggtgtttctgtaaaggaacagtctttcaaggcaggatttggaaaattcacatgtgtttcaaatatacttctagcgtgaatcagtttaccgctattgacatcccaaaataccaaggcattatcttcatggacagttaatatatgtaaggaatttgggtgataaagtgactgaatgacctttggagtgcgtttcttttctatgtttgtggatagatcaccgcccggagcatacggttctaattggtaaaaaaaatgttgcttgactttgtagtcaatgaaagaatatatgactgtaatatgctcatatgatataagtatcgttcctatgtctctaggattccattggatagaaataaccggtgatagcctctcttttggcaaaaacacacttttctggaagttttcaattttcaatttggacatttgatttctatccacatcatagatcaatatggatccactctcgaggccaatcagcatccaatccaagggcggatcagtctcaaaacaagtgatgctgtttggacagaaaacagtagttagaatctgtttcgagtgtactgaaaggactattatgttgctcttctcatctacagctatcagataaattcctttaataaaccgcatgtgtttaatttgaggtcgattttttaacgtaaatacgacctctatttgcttttgcccataaacatgtatctccccagcagtagttgcaactgccaaaaggctttgagtatagtcgaatgtggtaacagtgattcgtccatttatgccgtatgtgcatattttcttagtatcgaaaaatttggagttaataccatttgagacgtcatgaactctcgcggatttgatagcatttgacacattcttcaaatgcctgcttttcttaaacatttataaaatttttgtatctgttcaattgacaattttgtaacttttataatctgtcaactttagaaatatgttagtagtaatataatcctgagctgtttcttagatgcttccttaataatgtaaacagaatgcgcattgttgaacatacggcttcgcatcgcatcgcttaaacgaggtttttcatatgcatgctccaagataggtacgaacaaaaaagaggcattgcatcaaaatggatagtttcagtttatgtaacaaaatctcattaaaaaaaccctctcctcctatgaagcggaacagttcaacttttccgcttagatgttttatataaaattaaataaatcatggcatgaccttttcttcataaatccaaatcatctggcataaaggaaaatcctctaaactcttcttgctggctcgttgtcaaaacagagggcagaggtgtaagtgtgggtggcgcagaggtgaattcttgctcgaaatatgatgtatcttccggagatttaatttctgggatgtagggtggtttcacgcgaaggtttaagatatcgtcaaagttgatgttacggaagaaaggttcttccataacttcgtctgcgtccctgggaccagcacccaacctcttttcaggatcttttgttaataggccttggaatatttgtacaatctcacctgccatatctattgggtataagggttcatcggtaaggatagcgttaaaaacttcatcttcgtcatctcctgagaatggagattggcacagtagcatttgatatagcagcaccccaaatgcccaccaatcgacagctttggtatattcttgctcttttaaaatttctggagccataaattctggtgtgccacaaaatgtagaagttctattaccataccacatttcatctttacacaaaccataatcggcaatttttatatgaccttctggagttaatagaatgttttccaacttcaaatcacggtatattacaccattatcatgaaaatatttcagagccagtaagacctcggcggcataaaatttggcccttcttacagatagtctttggttttgaacatgccacattaagtcaccgcccccaataaactccatagcaaaatatatacggttttcagtttgaaaagagcagtatagattggttaagaatgggtgtttagtttttgtggctaacaaaaatactttcttttctgctcttgcactctcgatgtcatgattttgaataatattatctttcttcagaacttttatggcacaaagcctgtcagtattctttgatttagataaaataactttaccaaaattacctttaccaagaactttgagtaatacgaaattatctaatgaaaccttacgacgtttagccgctctctttttatgctttgcgcttgtgctggtttgtgatttctgcggagattgttgatcagtggttctggagggatgagtacttgtaggagccaaggacactgtttcttgtagtacttcctttgaagcatggtcttgttcaatttgaaaggtttcactattcatatcgcggaatggatttgtgtgtgtggaatctattgtcaaatcagcttcacggaaatcatttttgttctcccagtctagtttctgtttggtctctaaatcaatgtgatcaacttctagatcctcttggatttccccactatcttgttttatttcaagttccatttcctcacgttgtgctttccacagttcaagttcatctctcattaaatcatctttagattcccaagtttgactatgctcaatagataaatcagtgagtcccaaggaacgtctattcgacgttggatccagtgttttctctggtgatgaaaattcggcggtttgttgtgcaccttctgtaaaatttaaataggcctcattttcatcgataaatttatttagtttctcacgcccgtgcgtttgtagtgaaatttttttatcaataataggatcatgctgcttagttggagaatctcttcctaccttctgaggcgaaggagttttatcatgttttcttggctgaggaggcaaaggagcgtttgccctttcagctaatttggatggggaaagatcactaccattggcagtaccaatagatgaccccaactgtgccgacggaactgtcctcttctttttctcttgattacgttttgtgtcttgaatcgttttcagaattttattagccatttccatcgacatgccacagaaatcgggaaccaaatgagcacattgagcatgacacattataccacattcagaacatttgcgtactttatgtctaccccatggtaaaatataaccacagtgacagcaccatttagtaccacggtttgaagtaggcaggaatctatgaggaatacggtggttcaactttgcctcgtccggatccgtatcagtagaagttttagcaatacacttagtaacaacattggtgtaacattttttgtgacataaaaatttacaatcttgacattggaacccagtataccgaaggaaatcaccacaatatgcacagcacataatgttgtaaaatgatttttgtacaaagtggtggccatgctgttcgaatatctcttctttcctattgataatagcaccatgacgatgtagtccacccatcaactgcttcctttctatttgagaagacttgtggaatcctagtgttaacaaaatctgcccggatggttctaagacaaaccatgaattcgtactgatttgactagttgatgtattttcgccttgcacattctttgctgaagtagactgaatggctgagtttgagtatgtagaagtcaatgtgcttccctcttcgctagcgagagaagaaccaccattaatgtttgaagcgttgacccatccttgttgttcatttgtttgtccggctttcttcttacgaatttcttcagcgatatcggaaagcagtaaccacattatagccactggaatgagcgagtcgttcaccttatcatatacagtaatctcgatttcattccctttttcaactggaatttgaaaatcttcactccacctgtcatttctagaaggcttcgttctggctttgatcgtatcatcgatttttatagtaacgtagctctctggcttcctggcaaacatcggtgattgtatatggtcaacatctctagcagcagttattccaattgttagaacgccagtcagttgttttcttcggaatttcggttgttgattatccattatgtcattgggttggtgtttaaattgatcaaagtcaacgttaatagcttggtatttcttcaaagctttgttaagcatttgaatcctgtatttggattccatagcacccccttctgccgcagaactactacgttgatcaccgtcaatttgatacaatttagtcaatttagtattggcttcttggtattgcttttccacctgtaatttgaattctaattgttgcaacatgtattggattctttgcgccaaagaagggcaatcatattttactaaatccaaacgagaaaatatgtgttcatttggcgatttggtagaaagaaacccgtattccttcgaattgaatcgctcattatcttcgctgccattttcaccctgactttgttgagcggtcttcaaccgtaatttttttaagctatcctccaagtactcaagattttgacgtgcctctctaatattcgtattacatttctgaatgaccataacattgctagtctttttcttgagggcagaagctccccgaataatattttcttcgacggctatcttttttttaatgttctgctccaattgtgaaaaactcatgactgtaaactgctccctatatgtgtgatactatacttacttttcctcgctagagcttctctccgcagctactgttctaggttttattcctattgattatctaatatagttttaaaaatctatactgaaaggggatcgacgctgaatacctctaacgtaagtgtggacgagtggtggcagagacttttacaatggttaataatcagtctctactcagccaaattgaatagcagtgaaatcgtagctcttttactgctcctgaacctgtcgtattactttcgatagagtagatcaactttattatccacgcttgttaactcttttcgtcggtttttttcgcctttaaaactaggcgggctgggtaatgaagatagcaatgcctcataaatacaatgttatactaattacgttttttctttggttatgtatatatattgtgagaataaagagaagttgcaagatttggtttattgtacaatactacttattacactggcaggtgcaacctggagtgggacaaacattatgtctgtcaaaccattcttcagcgtgaccggcatgcataccatggttgcaactcaaacagaagctgaaccactcgttcaacttcagttttctacttacgagttcgcgatttgcaccatcttgagagtcttctgtctgcattggatcgcgtgattgcgtcccatttattacaaaaggtaagtttgacgttcctagaggcatgagacatatggcacatcttggaaatgaagacccacagtgtgggcaacaatacttatgtcttggcttttcatcagctgcttgtgcttcagaacttccagtattaaatttcttgtagtcagcgttatttcttctataggcttcaccatttttgtaatttccagcactagtagagacggcgctagaaggtgaggatgtgcgcggagtgttgatgttttgtttacagttttgacattggatatatatttgccggggctttatgtctgcagttaatacaccagttttagttctcgataattttgatcttaaaacatcgaacctggctcgcatggagaataattcccacgatttaagcatatctctataagtttgtatccattcatctactcgttggtcgcggaaatatctaggggagccgaaaattgatatcagtgcggcactctgaacatcgctggttttattaacgtatgattgcagtagatcgataccattaggtgttattccggtgagaattaaaccttctaattcgccgttttcaataactgtagatgaagttctatctaagaaagtggttaggtctgtatcattcaaaaaccttagagctacccctaatcgttctctcaaagatatggcaggttcataaagaatatcccaccaatcattgtctgcgataaaggcgaaaataactctcaagtaaggatcatctaattcggaggacatttttctgcattgctgcctccatgcattgttacctggcagatccttatacgccaagtaacctgcaatagcggtggcaattagtctcaatctttccttttttgcagatcccaatatttctacagcctttgggatatcaccaaaaaataccgcccaagcggcagctttttcataatggccgtttttcataattatgttgtacttgtcttcataatcagatctggaaaggtcccatcctgagataattaaacagagtcttctctgaacgtactttggtgaaccagcggcattggcaataggactgttccgatccctatttttccttcttagtttgatgattttttccatttctttatttagttgtttatcagaaagaattgtctcttgtctatatctgtcttggttcgatattccgtttataccattccaaatacctatcacaccttcgtaacctaagtcaagatcaccagaaaccatcgtaccatcgtcaacagaagcctttgcaatcgcgatccacctccatgtgttccttatataagcattgttttgtagatttttagaagaatcaatcatctctaccgtgttcattggatccaaaccatatcccaatgaagctcgcgtcctcattattacacttatatctttttccagaagtttttctggcttccagaacagttcaaatccacgcttactgtcaaggacatcattactcccttcattttcctcttcactcaactcggagtactcaatttcattattaggttcatcatgtccagacggaaagtaatcttcgctaacatctaaatcctcaaacgatagattctttaggattgtttttacattctctaagttggacttttcatgctcattgttgactctaatttcatctatctcagtattttcaaaatttgacaataagagagagttcctattattgagtatagccttggagcatacctctgaaattggcattctgtatattgttcccgattgtctcatacagattagacttgttccattattacttcttggaatataatcaaatgtagcaactctatcgtacatcgtatttgtgtcatgcacggaagaaacaaacaaattctcaatattcatctcgttatcgtcatctgccgcaatatcacgattgctatcgcagtaatagcctaacctccatcttttgatggtatcacctctatgtaaggtggcaaattcattgttcctcacacatgaccacctaaagcaagagttcatgtatttccttgacgctgcaccggatccaaccaatttttcaaaagttaataaaggggaagctacatttaaatcaccaagtgaagcttggtcagataattttctcctatcccaaatagctaaggtcccatcatccccataagtactaaattgccaatcgttaaacgggttcagtttgatatcatacgtcaatcgtgtcggatgttgataaattgggttgggggatctgacgtcaatttctttcaaaaatttcgtacttgcagccaatacactggtatcgttgaggaactttagggatactatgctttcatttgtgcaataactaaacattgggttgatagtttcatgcgaatcatcatgataattcatgtcccaaatttgtaaagatgaatcatgcttatttctgtcaagacccattgctataagaccattcgtatttattcccagagagtttatacaccgctgcttctttgctcgtacacgtatatcataattggtttctgaaacagggtacccttgggtatcctttaaatttgagacagatccaactatattttccgcctgagctgccttaccaccgctggcatttgtcatagaagtctcgttattggcatttaagcccactggcgcatggctcgctggcgatgaggaattttgtccagagatattaaaaatccttaaatatccattcttttcaccaactccaatcataccaatttctgattctgaatagtctaagcaggtgatactgccgaagtctttcacagtgtgtaatttaataattgattcatcagattcattttccggatccactttatagtgggtcacttcatctcttgtagggttcactgaaagataatcaatcaaattatcatatgaccaatgggtcacttttttgatgagacccatgtttattcttctatacgttcgtgatactgcacttacgactaccagtaacatcagaataaccatagagcttatgctatcttgaatatatcatcgccgtaaagtatgatgtgtagcgcattagtcttctgcattcatattatcagtggtataccgtttggtatatgctttccaatcatgaagtgttggctctactctatataaattcgacatccattgattttctcaataaatgagttacccaagtaagctttccattgatacaagtgatctacattcttgcgacgccaaattataaagcactaaaaatcatatcatacccaattgcgggcagcacatgtatatattatacactacttataactaaccttcttcatatataacaatatgcctgataatactaatgcatttaaatcatatcatgaaagaaaattacatgggttttattgacataattgcatttagaatacataaaattctaaagaattaatatatccaaagtattagacataaccaagaataatagtgaataattttagattttgttacatataattctgcttgcctatctcttccactcttttcaaaacgttgcatgtaagcgttactaatattccgctttattttgttgcaattcctaattttttcattacattatcttgcgagtacggaagcgattaacgttctcccaatagaaggaacaaacatagatattgaagttttactgcttttgcttacctgacctttttcaaatttaattttttcccgctaataagaccataaactaccccgaaccaaattctaaaagatagtcagctggattagagttgtcatctccaaacattaattttgcattatcttcggcttcaatcaaatcgcctgataagaactcctttaattcttcatgaatgtttgtatgtggatgactctccatagtgccagcatgattgtggttaccgaccgaatcatataacggtggctcccaattgtgcaattcagccttactattttgttcattcatcaaagcatttgggacagatctaatatctataattctttcctcactattctcgctattattttgccccgaactggcatggtggttattggtaaaaggagataatgctgcgacagaacttttcttctcttccaattcttttatcttcgccaataacgccttcttttttcgtgcttgtatttctaaaatttcggccaggtattgtaaatattcgaccgttctatccaaaatgatacccttatttggtttgatttgtttacctaggtcatcgtaattcaataaagatggtggaaccaactggccgagttcttttatcttttgctttattaattctcttcttctcctttcgacggcattatgaaactctcttttgcgcctcagtttctcatcagaagttaacccgcctaaaatctttggaacacttccaggtcctatattttcagtcatattgctacttattgaagtgtgtcttgttctgggtgtgtttatgctaccatgcctaaaagaagatgaaaggaaacttcctgcacgaaatgacgatgatggtgatcttacctttggggaatatgtggaagatacggatgctgggcccaagctttgtggattataagaaaatgatgatgaatatgtgtttggtgtcatcatatcagaattgatgctagaagataaagaggagctcaaatcatcagttaagttatacattgtgtcatcggtgccatgctgaaataaaaagtcatgtggtaactcagcttttaagccttcttgttgctgtaatggagtattcattgctctatccacaggtgagtcgtaagccatagaataagatgatctcaagggaccctgccctatggaagatatggaattttgagtgacaggtctaccgccttggcttgttctaaacatatcatccaggtaagacgattgcgattctgcttcctcatatatggtcgaagctgtaggagtttgtgaattggacctcgcttgactgcccattaagttattattatcgttagagttgtgcgtattgatgtatgagagtttttcatgctgttgggcaggagtctcaccacctgggtaggcacttccgtgtatcttgtaatcatcattgtggtgtggagtgggtgtcactaacgaaaaatctaaagtttcctggaggacttttgtctggttcattaattcgtccagtagacgttggttctcagcctcactttcgttattgttcatcattcttcacttatttaagaagtaggttcgcctgacaaaaaataagagtattctattaaaggatacttgtcaactaagtaatgtgaatgcagtaatgtcgtttttgttatcttatatatgctcacgtaagacagaaattcggattgtgaaaaattccttgatgattccgtgcagcctctagccaaaatagcaactgcgagtaaaaaataatgtactaacctgcagtaatattggagatcctactgtccggaccgagtagtacaattgttagtttctgttgctcataagaaggcttttctaatcaccatggctttattatttcccaaaagtaacttgcgaagagtcacatcccgcggaacggcccgcaatcgtgacccggccaaaggcgattgtaatgaagagggagtattggtcagacttgtactatactgaaataggaagaagattgaataaatttgcattctaattgcgttcggtagtttagagtaggacttagattacctgtattgtctgcagttgcgttttttttttttgctggtaaaaaaaaagaacaagtgtggagaatatgagcgaggaaccaccttctgaccaggtcaatagtctccgtgactcattgaatcgatggaatcaaacaagacagcagaactcgcagggttttaatgaatctgcgaagacattgttctcaagctgggcggattctctcaataccagggcccaggatatatatcagacgttgcctgtatctagacaggacttggtgcaagaccaggagccgtcgtggttccaattgtcaagaacggaaagaatggtactttttgtctgttttcttttgggtgcaacagcctgtttcactctttgtactttccttttccccgttctagccgctaaaccaagaaagtttggtttactatggacaatggggtccctactatttgttcttgcgtttggggtacttatgggaccactcgcgtacttaaaacatttgactgcaagggaaaggctgcctttttcgatgttctttttcgccacatgcttcatgacgatttatttcgcagccttttccaagaacacggtgctgactattacatgtgctcttcttgaattagttgccgtcatttattatgctatttcatatttcccattcggtgcaacaggtttgaggatgttaagctctgctggtgtcaattcggcaagaggtgttctgcgcatctgaattatcattcatagtgcatattgaattgattagttgaagaagaaaaataatgtttatgttataagaaacaataataaagagatttataacctaacctaattaaatagcatgtagtcaacaaaaagggagtaaaacatgcagtggctctatatatataattatcgtagaataattcaaaaaaaaataaaaaacgaaaaaattcattcttcatcactcatcaaaggcactatttcgtcataacgcggaggctcgttaccatgagagagtagcgaatctgcggagctcgaacttactattccttcttgttcttcatcatcttttacattcgctaaagtgtaaccctttttgaaaaattcgttctgtttgtccttagagttttcagtggtagcgtttggaatcctcacagtaccatttgcttgtgataagccatttgttggtgatgaattgtgagatctattgacgggcgatggagtgctcaataatttatcgagattattgaatcttgacctgtcattcactgacgttgctcttgctctagcaacaccttggccactattgcccgaaacaaatgcggaattcgaaatactgccgttcatggcattggcatttgaaatactgttccgattaacatttggcacaccggcatcatcgctgtatccggatggcccactaactgacgtagttcttgataagttcaattgttgaatagatagtaaatcagggtcatacgaggccatgatattaggtgatcccatcggtgagacaatgggagaagctggaacggatatggcttcttcaaaagttggcggaggtggacatgtgttaccaaaaaagtcgctgttcatacttagaggaacctggttgcctttgccttccattgtggccatatcataagtgggtaactccatattaccactgttgcactgttcagacaccaggaatatgggcgtatcgattagaacctcataatgtcttaatttggacggacactcaggatcaggtttactgattcgtagcataatttccagcttatgtctacagtaaacattactgaagtgtaaactatccaagtacaagcctcttttcggtgtgtttaatctggtatgtgttttcacgggcaaaccagaattggatttgattattgtttgatggaattttggatcataaacaggtttttcattttcttcatgacttttcgagcctttatgaccggataaaaagcctattacactgggacgacggtgtgagggtccattggctacggcatgttcgggattggggatgctcgtgtatgcatcgataccataaggtggtattatctttgcggttcttttatccaaatcttcgtatttggggaacttcaattttgtttcaataattattggttccgttataccgagcctttctttcggattgccttttgaatcgctgtcgtcatcaaaaggactataagataagagattgtcattgaatgaattttcaacaatttcctcccttagagctctcgtgcccttctccttagttctgatttcaaataatgatacacttctttcctttcttctcttggaggcgaaatctaaataatacggattataagggtctttagcaacgggatctgtttgatcatactcatattcataacctttactaacaaatgtgactctttcagtaatactgacatgaatacgtttaacacaaacgtttttgcatatcggtgccaattttatcttgattgggacttcactgtttagtgaaacgtatttctgagcaaaggaaatctcgtatgacaaagaatctgtccaaaccctattaatatagattggtttattcgcagtggatacggcaacgggcggtggagttctaataacttttattggatactctgcgaaaatgtcctcttctcctgattcttcatttttcagttgatgtgagctcatgtgtagatgatttttaactttactaaacaaagtgttgcttatcctcctatgggcctgagcggattctgtttcggtaagttttaatgaagatgtagtggagcttagtgatgaagaagagtctggcgacacaataggttgcggagagtttgaatcttgacgatagaaaccctttctattgattgcctttgttgcaagccttagtctgtaactaacacgtgcagagggtaaatagatagtctccggaatatgattagagaaaaccactggtactaagaatacatagtctccaggttggtaaagatgagtcttatttacgtctatggcgtttaaaaggctggcttttgttttagtcttgtccaaatacagtctctcctctgtaggaatattcttgaacaacctcatttgacgatcgttggagttgttttcaatcatttgatcatctggggatatgcttaatggtacaaacaaatcgaagttttcatcattcaaattccatttcattgatgcagcattataaaattcttcattaaacgtctttgtaggaggaacacctgtattccaaaacactttaacccttgaacataattccaattgcatgtccgtaaatcgggttggttttttaacggatactataactgctatgctgtaagagaccatggaactgtcgatttcaacagaccttgtattaagttccgagccggagcctggatggtctcctgaattattttctctcaggagtgtgtctctattttcatttatgctgccaccactttcggtagccgctgccgttgtagcgagagatggagtgttaccttcttgctggtctataccatccataaaaaaatccgcctcagcatcgtccgtaccatcattgagtccgtttagtctggacaggtactcatcgtcattcgaggatatcgttggtaagaaaacgctttcaccgcttgtagaaatagaaatcttcaagtactcattggatagaacggtttttgggcccaggagacctctagcggttaaatattctatgagaaattgctcgttaaactttttcgagtttgccaaccttgttagagaagttgatgataaatcgcttgacactacagctgatgagttatggtcatcatcaaaatctagtactgtgctatcctcctcaatctgtgaatagcgtcccccagagattctgggctcttggtctaccgacaatcttcccgaagtgcgacggttggtgtcggaagtcgaggatctcggagtcgtagtagcactatcgctgatagagccctgtatggcagtggtactgtgtcgccttgcgtttggcggcggctgtttgttctgttttttgccaaggagttgggcgtctgtattgctgcttctgatgttgccgttattattgccgcctttcgttgtgttgttcaagacggcaggtgagtgaacattagcgccaccaagtaaagatgatagcgcgtgcctaatggtggaggatcttcttcgttgttgcatggaccctaatttcttggtgggagagggttgaaacggctgtcctttagactggtttaaatctgtttctgataaagagtgggatgaatttttcgccaccggtcttgatgttataaacggcatgcccaataggggtagggaaaaatcttgcttgttcttctctatttaaaagagtcacctttccgatggaccttcaaaaatataaacgtggcttatctcagagctaagacagaccttccgagcaataataatgagtcgttctattttttttttctcgtccctttttttgtcccctcttaacaaaattagaaatataggcgggaaagtggagaacccttggaagagtcagatcagagattggaaaaattaagaccaatggatatctacagatcctgtgaatcgagtgtgagtgatataccgcaagatcggtagaaaactgtatataaagcaaagaactgatgtggtgtaaacgatgtagcgatgtaacaagagatactcggtaatgtaatcaagatgctctttttttttttttgcggcaatatggtgtacgtaaaattaaggttccgtggagtctgtgcttgcgaaaatgatattgacgcatggactgtcgaaataataaatttacaattaaacacttggtgatttgaatgtaatttgaacgtttaaaaaattccaagggaatattactgtttcgggaatataacgtttgatcgctagcgcacccagatgagaatccgcatggatgggttgttagtatttctattgtgaaaccgctttgttctggagggcgagaaaaagttacggtcactctatcttttttataatttggtctaacaaacttgatatcagaaccacgtagaagaaaaagagactaatagtaaaaatatcaagaaagttgaccaatttttgttatatatgtccgtaaaagttatgacttggcactggtcttggtttactcatcaatcagctaggatcagcgctgagtgactgcttgcggctgggcggctaagaaatgggaatatgtacagtacaaattccgaactttgcgagcctgcctcgatggttttttaaggtgttcttttcttgcataccaaagcgtacacttgatgcgccgcttgacgttatcttgttctggatgaggccttatttttggtcttcattgttaaaacaccctattgtcatttagcagccgatgcgatgaacgaaactgcgaggtaaaagcgctcaaatcaaaagtgtagtatgaatgatatataaacaacttcaataaagtcacgcgtagttaaaatattgttagggtaatatcctgtgtccttcgaatatctgttggaataagaagcaacatcatctactgactagtattcgtgatactagtattcaatcacgtaaggtggaagagaatgacatgaagattgagaaacagtgatcaaactcaataaagagctgaatacaagcacatataattgttggaataaaaatcaactatcatctactaactagtatttacgttactagtatattatcatatacggtgttagaagatgacacaaatgatgagaaatagtcatctaaattagtggaagctgaaacgcaaggattgataatgtaataggatcaatgaatattaacatataaaatgatgataataatatttatagaattgtgtagaattgcagattccctttcatggattcctaaatccttgaggagaacttctagtatatctacatacctaatattatagccttaatcacaatggaatcccaacaattacatcaaaatccacattctctacatggtagcgcctatgcttcggttacttctaaggaagtctcatcaaatcaagatccgttagccgtttcagcttccaatttaccggaatttgatagagattccactaaggttaattctcaacaagagacaacacctgggacatcagctgttccagagaaccatcatcatgtctctcctcaacctgcttcagtaccacctccacagaatggacagtaccaacagcacggcatgatgactccaaacaaagctatggcttctaactgggcacattaccaacaaccatctatgatgacgtgttcacattatcaaacgtcacctgcgtattatcaaccggacccacactatccgctgccacagtatatcccaccgctgagtacttcctcacctgatccaatcgattcacaggatcaacactctgaagtacctcaagctaagacaaaggtgagaaataatgtcttaccaccacacactttaacatcagaagaaaacttttatacatgggttaaattttacatcagatttttgaagaactctaatctcggtgacatcattccaaatgatcagggtgaaatcaaaagacaaatgacttatgaagaacatgcgtatatatacaataccttccaagcatttgccccatttcatttattgccaacatgggtaaaacaaattttagaaattaattatgctgacatccttacagtcctttgtaaaagtgtgtccaaaatgcaaactaacaatcaagaattaaaggattggatagctcttgccaaccttgagtacgacggaagtacatctgctgatacatttgaaattacggtcagcacgatcattcaaaggctaaaagaaaacaatatcaatgttagcgacagattggcctgtcaactaatacttaaaggtctatccggtgacttcaaatacctacgtaatcaatatcgtaccaaaacgaacatgaaactttcccaattattcgctgaaattcaattaatatatgacgaaaataaaatcatgaatctaaataaaccgtcccaatacaaacaacacagcgaatacaaaaatgtttctcgcacatctccaaacacgactaacacaaaggttacaactcgtaattatcatagaacaaatagttcaaaaccaagagcagcaaaagctcacaatattgctacatctagtaaattctcaagggtgaacaatgatcacattaatgaatcaaccgtttcatcacaatacttaagcgatgacaacgaacttagtcttaggccagcaacagaaagaatctaagccaacacacacaatagactcgaatgacgaactacctgatcaccttcttattgattcaggagcttcgcaaacgcttgtcagatcagcccattatttacaccatgcaacacccaattctgaaataaacatagtcgatgctcaaaaacaagacattcctataaatgccattggtaatcttcacttcaactttcagaacggcaccaaaacatcaataaaagcactgcacacaccaaacatagcctatgatctattaagtttgagtgagctggctaatcaaaatattactgcctgctttaccagaaacactttagaaagatcggatggtacagtactagctcccatagtcaaacatggagacttttactggttatctaaaaaatacctaattccttcgcacatttcaaagctaacaataaacaacgtcaacaaaagcaaaagcgtaaataaatatccatatccgttaatacatcgaatgcttggacatgctaacttccgaagtattcagaagtctcttaagaagaatgcagttacatatttgaaagaatcggatattgaatggtctaacgctagcacatatcaatgtcctgactgtctaatcggcaaaagcacgaaacataggcatgtcaaaggatcacgactaaagtaccaagaatcatatgagccttttcagtacttgcataccgatatatttggtcctgtacatcacttaccgaaaagtgcaccttcttactttatatcgtttacagatgagaaaaccagattccaatgggtctacccattacacgaccgtcgtgaagaatctatactcaatgtttttacatcgatattagcatttattaagaaccaattcaatgctcgcgttctagttatccagatggatcgtggctccgagtacactaacaaaactcttcataagttctttacgaacagaggtattactgcatgctatacaaccacggcagattctagagcacacggtgtcgctgaacgattaaatcgtactttattaaacgattgtcgcacactgcttcattgcagtggtctaccaaatcatctatggttctcagcagtcgaattttctactataatcagaaattcattagtctcaccaaaaaacgataaatctgcaagacaacatgcaggtttagctggactggacattactactatactacctttcggtcaaccggttatagttaacaaccataatcccgactcgaaaatacatcctcgtggcattccaggttacgccttacatccgtcacgaaactcttatggctatattatctatcttccatcattaaaaaagacagtagatactaccaattacgttatattacaagacaaccaatccaaattggaccaattcaattatgatacactcacctttgatgatgatctcaatcgtttaacagcccataaccaatcttttattgaacaaaatgaaacagagcagtcatatgatcaaaatacagaatctgatcatgactatcaatcggagattgaaataaactctgatcctctagtgaacgacttctcgtcccaatcaatgaaccctttacaattagaccacgaaccagtccaaaaagtacgtgcactaaaagaagttgatgccgacatatctgaatacaatattcttccatctcctgtacgatctcgtacaccccatatcattaataaagagagtaccgaaatgggtggtaccattgaatcagatactacttcacctagacactcgtctaccttcactgcacgaaaccaaaagcgacctggtagtcccaatgatatgattgatttgacctcacaggatagagttaattatgaacttgaaaacatcaaaactacccgtttgggtggtacggaggaaccatatattcaacgaaatagtgatacaaatatcaaatacaggactacaaatagtacgccctcaatagatgaccgttcgcccgacagtgactctactactcccatcatctccatagaaacaaaggctgcatgcgataatacaccctccattgatacggatccgccagaatatcgatcttctgaccatgcgactcctaatataatgcctgacaaatcctcaaaaaatgttacggctgattctattcttgacgacctcccacttcctgacttaactaataaatctcctacggacacttctgatgtttcaaaagatattccacacatacactctcgtcagactaattccagtttgggtggtatggatgattctaatgttctgactactaccaaaagtaagaaaagatcattagaagataatgaaactgaaattgaggtatcccgagacacatggaataataagaatatgagaagtctggaaccaccaagatcgaagaaacgtataaatctaattgcagcaataaaaggagtaaaatcaatcaaaccagttcgaacgaccttaagatatgatgaagcaattacatataatgaagacaacaaagaaaaagacagatatattgaagcttatcataaagaaattaaccaactattgagaatgaacacttgggatacaaacaaatattatgatagaaatgacatagatcctaagaaagtaataaactcaatgtttatatttaacaaaaaacgtgatggtacacacaaagccagatttgttgcaagaggcgacattcaacaccccgatacatatgattctgatatgcaatccaataccgtacatcactatgcactgatgacgtcattgtcaatcgcattagacaatgactattatatcacacagctggacatatcctctgcttacttatatgctgatatcaaagaagaattatacataagacctccaccacatttaggtttgaatgataagttactacgtttgagaaaatcactctatggtttgaaacaaagtggtgcaaactggtatgaaaccattaaatcatatttaataaattgttgcgacatgcaagaagttcgcggatggtcatgcgtatttaagaatagtcaagtaacaatttgcttattcgttgatgatatgatattgttcagcaaagacttaaatgcaaatgagaaaatcataacaacactcaagaaacaatacgatacaaagataataaatctgggtgaaagtgataacgaaattcagtacgacatacttggattagagatcaaatatcaaagaagcaagtacatgaaattaggtatggaaaaatccttgacagaaaaattacccaaactaaacgtacctttgaacccaaaaggaaagaaacttagcgctccaggtcaaccaggtcattatatagaccaggatgaactagaaatagatgaagatgaatacaaagagaaagtacatgaaatgcaaaagttgattggtctagcttcttatgttggatataaatttagatttgacttactatactacatcaacacacttgctcaacatatactattcccctctaggcaagttttagacatgacatatgagttaatacaattcatgtgggacactagagataaacaattaatatggcacaaaaacaaacctaccaagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcagtcagtgaagctataccgctattgaataacctcagtcaccttgtgcaagaacttaacaagaaaccaattattaaaggcttacttactgatagtagatcaacgatcagtataattaagtctacaaatgaagagaaatttagaaacagattttttggcacgaaggcaatgagacttagagatgaagtatcaggtaataatttatacgtatactacatcgagaccaagaagaacattgctgatgtgatgacaaaacctcttccgataaaaacatttaaactattaacaaacaaatggattcattagatctattacattatgggtggtatgttggaataaaaatcaactatcatctactaactagtatttacgttactagtatattatcatatacggtgttagaagatgacacaaatgatgagaaatagtcatctaaattagtggaagctgaaacgcaaggattgataatgtaataggatcaatgaatattaacatataaaatgatgataataatatttatagaattgtgtagaattgcagatcccctttcatggattcctaaatccttgaggagaacttctagtatatctacatacctaatattatagccttaatcacaatggaatcccaacaattacatcaaaatccacattctctacaataatagaataatgaacgataacacacactatgaaagaagaataataataataacactgtatagaaatagcggctccctcttgtttattctcacatcctcgagcaaaacttctagcaaatcctgtgtatttaatattatggcctctatcagcaatggactcccaataattatccaattactcaccaatttttcaatattagtgtagataggaaaggatcctcgatgaaatcgttatggttagtgtctctgttgataattagaggttaaaaattagtattaatgaagaagtgagtactgatcttcttatactaaataagagaggtatataaaacacacgccgattggtcatattaattatgaccaatataatagtgattccggtagttactatacattgatgtgacgactcatattcctcatatatgtacctaccataacatgttcaactaataggtctttaacacagcttcagtattgtctgagcttctcgtttaacattccttctgcaataggcgcaatcacacttaaacgtatacgagttgtacattaatatacgatgtaagcattagattgttaccatagcaactcatgtcactattaattactctcgttccaacagtctcgatccactgtgtgtattcttggaaaatgaacaaatcagtgtagagaagtcgtcttcgtttccatcatgagaatgtgcttcagtattactttttttgccttcaacgccttgattgttctatttttgctaataataaatctatttcatcggactaaaagtccattagttgtaagcggatttagctcagttgggagagcgccagactgaagaaaaacttcggtcaagtcatctggaggtcctgtgttcgatccacagaattcgcattcctttttgctagcattcttttttttttcatttctaggcctgtttctccgcgctgattggtcgcccgggtgatgcagttgcggccggccctggccaatcagatccctttaaaaatgggcccggtgcgcttctaccccttcacgccttttacgcctttttcgaatcttgtatttattgtaattattaaacattggtcatatcaaattcacatcagacttcaatttttcaattcactttctgaataagagcccttcccttcatacaagtagagatattatactgtcatagctctttcaattggtcttattagattgtctccatctttcccattgacgttgttactccctctcttttttcgtttttaactgatttctcatatattcccaaacaggcatatatactcgacgtcaagaaagaaaagaaaagaaaaccctcataaaaaatataatcgagaagtttttttcctcatcgcgaaccattagtataacagattgatcgttcagctctcataactatcgcaagaacagtaacaaaataaataaaaaaaacacgcacatataataatgttggctcgtactgctgctattcgttctctatcgagaactctaattaactctaccaaggccgcaagacctgccgctgctgctttggcttccaccagaagattggcttccaccaaggcacaacccacagaagtttcctccatcttagaggaaagaattaagggtgtgtccgacgaggccaatttgaacgaaactggtagagttcttgcagtcggtgatggtattgctcgtgtttttggtttgaacaacattcaggctgaagaattggtcgagttctcctctggtgttaaaggtatggctttgaacttggagcctggtcaagtcggtatcgttcttttcggttccgatagactggttaaagaaggtgaattggtcaagagaaccggtaatattgttgatgtcccagtcggtccaggccttttgggtagagttgtcgacgctttaggtaaccctattgatggtaaaggtcctattgacgctgccggtcgttcaagagctcaagtcaaagcaccaggtattttgccaagaagatctgtccatgaaccagttcaaaccggtttgaaagccgttgacgccttggtccctatcggtagaggtcaaagagagttgattattggtgatcgtcaaacaggtaagactgctgtcgccttagacaccatcttgaatcaaaagagatggaataacggtagtgacgaatccaagaaactttactgtgtttacgttgccgttggacaaaaaagatctaccgttgctcaattggtccaaactttggaacaacatgacgccatgaagtactctattattgttgcagctactgcatctgaagccgctcctctacaatacttggctccatttactgccgcatccattggtgaatggttcagagataatggaaagcacgctttgatcgtctatgacgatttgtccaagcaagccgtggcataccgtcaattatctttgttgttgagacgtcctcctggtcgtgaagcctaccctggtgatgtcttttacttgcatccaagattgctagaaagagccgctaagctttctgaaaaggaaggttctggttctttaactgctttgcctgttattgaaacccaaggtggtgatgtctccgcttatattccaaccaatgttatttccattaccgatggtcaaatattcttggaagctgaattattctacaagggtatcagacctgccattaacgttggtttgtccgtttctcgtgtcggttccgctgctcaagttaaggctttgaagcaagtcgctggttccttgaaattgtttttggctcaatacagagaagtcgctgcttttgctcaattcggttccgatttagatgcctccaccaagcaaactttggttagaggtgaaagattgactcaattgttgaagcaaaaccaatattctcctttggctacagaagaacaggttccattgatttatgccggtgttaatggtcatttggatggtattgaactatcaagaattggtgaatttgagtcctcctttttgtcctatctaaaatccaatcacaatgagcttttgaccgaaattagagaaaagggtgaattgtctaaagaattgttggcatctctaaagagtgctactgaatcatttgttgccactttttaatgtgaactaaaaaaataaaaatgaatataaggtacgtctccaaaagaaatgtaaatatagaaattttaaaaaaaaaaacgaaaaaaaacataactaaatttaaagtgcagcccaacaataaccctgaaaaatctaaatatcttagaatttttttattttgattattatatattattattattcttatggtaaataatgcccctacttttcttctaaggaagtgagttaccaccaaaataaggaaatatcgcctgcaagcggtttttattttggagttgtttttttttttcccacaatagcctctagtttattccattcttagcactgactcttttttccgccactatttcttataaaaggcccgaatttctggcacggacgttgtttttaataataaaatattgaatgacagttaaaaaatcacgtagtcagttaatctgtttaacttgaaaatatgtctgaatcagtggccattataggtgcaggattagtaggctgccttgcagctttggcattctccaaagaaggctacaatgtcacactatatgattttagacaagatcctcgattggacaccaccaaaaataaaaatttgaaatccattaatttggctatttctgctcgtggcattgatgctctgaaatcaatagatccggatgcttgtgaacatattctgcaagatatgattcccatgaaaggcaggatgattcatgacttgaaaggcagacaggaatcacaattgtatggcttgcatggagaagctattaattctatcaatagatctgtattaaataatagccttttggacgaattagaaaaatctacaacagaactgaagttcggtcacaaattagtcaaaatcgaatggacagatgataaacaaatctgtcattttgccattggggaagatttgaaaaccccacatactgaaaagtatgattttgtcataggttgtgacggagcatactctgcgacgagatcgcaaatgcaacgtaaagttgagatggatttttcacaagaatatatgaatttacgttacattgaactttacatcccgcctactgaggaattcaagccaaactatggcggaaattttgcaatagctcctgaccatttgcacatttggcctcgtcataaattcatgttaattgcgctcgccaacagtgacggctcgttcacttcaacctttttcggttctaaagatcaaatatcagatctgataacttccaagtcacgtgtgagggaattcttaatcgagaactttcccgatattattaatattatggatttggacgatgctgtcaaaaggtttatcacttatccaaaggaaagtcttgtctgtgtaaactgtaagccatacgatgtaccaggcggaaaggccatcctactcggcgacgctgcccatgcaatggttccattttacggccaaggtatgaattgcggatttgaagatgtgagaattcttatggcgctattgaaaaagcattcaggagatcgttcaagagcctttactgagtacactcaaacaagacataaggacctagtttctattactgagctggcaaaaaggaactataaagaaatgtcacatgacgttacatccaagcggtttttattaaggaaaaagctagatgctctctttagtattataatgaaggataagtggatacctttgtatacaatgatatctttcagatccgatatctcgtattctagagctttagaaagggctggaaagcaaacacgtatcttgaaattcttagaatctctgacactcggtatgttatctattggcggttacaagcttttcaaatttttgacaagagaacgttcctgaagccagtttattcttgccatccgtgtacgctaggagaggattattaaaataagtgatatatacatatatatatatatatatatatatataatacactaattattttatgtgatgttgatcacgcgaaacggtaaacggctctgttcgcgctttctttgtttacattttagtgaagtattgtcaagataatatccatatggttgaactttttatattggctagttaaatactctatttattgcaccaaaaaatcatcttagtggactttttggagcaaaaaaaaccagcaggtagttatataagatgactacacaactaaggtatgaaaataacgatgacgatgaaagagtagaatataatctctttaccaatagatccaccatgatggcaaattttgaagaatggatcaaaatggctacagataataaaatcaattcccgaaatagttggaatttcgcattgatcgactatttttatgacttggacgttttgaaagatggcgagaataacatcaattttcagaaagcatctgcaaccttggatgggtgtattaagatttactcttcgagagttgattcagtgacaacggaaacaggtaagttattgagcgggttggcacaaagaaagacgaatggggcatctaacggagatgacagtaacgggggaaatggtgaagggcttggaggtgacagtgacgaagcaaatatagagattgatcccttaactggtatgcctatatctaatgatcctgatgtgaataacactaggcggagagtgtacaacagagttttagaaacaacattggtggagttcgaaacgatcaagatgaaagagctagaccaggaattaataattgatccattattcaaaaaggccttggttgatttcgatgaaggtggcgccaagagtttattgttgaacacattaaacatagacaacactgcaagagtcattttcgatgcatcaattaaggatacacaaaacgtagggcaaggtaaacttcaaaggaaagaagaagaattaattgaaagagatagtttagtagatgacgaaaatgaacctagccagtcattgataagtactcgtaatgactcaaccgtaaatgattccgttattagtgcaccttccatggaagatgagattttatctcttggtatggattttataaaatttgatcaaattgcggtgtgtgaaatttcaggatcgattgagcaactaaggaacgttgtcgaagatattaatcaagcgaaagactttatcgaaaatgttaacaacagatttgataacttcttaactgaagaagaattgcaagcagctgtcccagataatgcagaagatgatagcgatggctttgatatgggcatgcaacaggagctgtgctatccagatgaaaatcatgacaatacatcacatgatgaacaagatgatgataatgtcaacagtaccacaggaagtatattcgaaaaagatttgatggcatactttgacgaaaatctaaatagaaactggagagggagagaacattggaaagtacgaaattttaagaaagcaaacttagtgaataaagaatccgacctgttggaagaaacgcgaactactataggagatactactgacaaaaacacaacggacgacaaatcgatggatacgaagaagaagcataaacaaaaaaaggttctggaaattgatttcttcaaaacggatgatagttttgaagacaaagtctttgcctcaaaaggaaggacaaagattgacatgccgattaagaacagaaagaacgacacacattatttactgccggatgacttccatttttccactgatagaataacaagattgttcattaaaccggcgcagaaaatgagtctgttcagtcataggaagcataccagaggcgacgttagttcggggctttttgaaaaaagcacagtttctgccaaccattcaaataacgacattcctactattgcagatgagcacttttgggcggataattacgaaaggaaagaacaagaggaaaaagaaaaggagcagtctaaagaggttggtgatgtggtgggtggagcgctcgataatccgtttgaagatgacatggacggtgttgacttcaaccaagctttcgaaggaacagatgataacgaggaggccagtgtgaaacttgatttacaggatgacgaagatcataagttccccattcgagaaaataaagttacttattcaagagtttcgaaaaaagttgacgtaagaagattaaagaaaaacgtatggagatcgatcaacaatttgatacaagaacatgacagtaggaaaaatagagaacaaagctctaatgacagtgaaacccacacagaagatgaatcaacaaaggagctcaagttttctgatatcattcagggtataagtaaaatgtattcggatgatacactaaaggacatttcaacaagcttttgttttatatgccttctacacttagccaatgagcatgggttgcagataactcataccgaaaactataatgacttgatagtgaattatgaggatctagcgacaacacaggcagcgtcatagttgatgatctttttttttttttttttttttttttttgtgctgcaaagtttcttaaagccttcgggcttacgaaatcctttatcgccgaaaggggaccgcttcgaaaagtggatataaaacaaggtatttatttttatagacaatgaccaaatgacaggatagatcgagggtgagttccaatatgtccagaactattccatttctatttaaattagtcaacagggcagtaattttgcctacggcaggttttacattaggagttggtgcgtttgtaaaggcgtggcccgatgatgccggtgttctatcattgaatgatccgcaaacgccagcggagttgattagtgcgaccaagagccgccaacctatggagctgcagagggttgacatcctcgctcaaatcgagaaaagcgaggtttacaacaagttggcccaggatgagaagatgcaccatgtcttattcagtgagaaaataccaagcgggcatagggaatatcatgtaggacaaggcctcttgttcggcaaggggaagcttgaaattgatcctttggtgttccatgatgtgaatcacggtgaattaaccgtgatttatcacttaggtgctgagttagggaatcgagacggtaacgtccataagggcttgttgtcattgttgctggatgaagcattgtgctattgtggcttccctttgttgcctagtaaaagaggtgtaactgcaaggctgtcgctagagttttttgaggacattcctgtagatactacgattatactaaaagcaaacgtcaaagagattaaaggcagaaagtgtatcattgagggacacttggaacagtttccgttggaagtttcttctcgaaatggaactagaagttggaacttaccacatatttggggtttcaaccataagcaggagatggcaaaaaaatttgccaaggccaattgtattctcgttgagcctacttggttcaaatattttaaatggcttgatatgttttgaaaaagcatgcctgtctcaaaatagcctattccgtgttaattaatattctatattcaaaaaagttaaacatatatactgcatgtacttaccgccgaagcacaaacgtgccacttccatgaacacttgctctttatttatagtggggctgatatgcgatggcgtaaagctactccagcctccttcttttcatatcctcatgactgtcactatgtgttggtgtagccatcgaacttccactagatttgttcttccttttcttactattgttacctgaatttgagccggattggctttttcctgtaccgtctagatcaaacgccaagtcgtctatatcaaacggcgcttgggctcccccttggttctggtttgcgaactcgcttggatatgacctttcaaactgcgatagtaccgaagagcaaaggtcccaatcgaaatttggaggctgaaacaatgctatgtctctattgcgcagctgttcgcgccattgttgctctgacatgttttgaccctgctgaggtggttgtatcatcatgtctgggttattttggaaaagaatatgtgctatttgaccacctttaccattttctctggtcggtatggtggagaatttacctgaaagatctgctatctggttcttgtaagattttcttagcttcacggctttagtgccgtccaaatttgttcttgccacttgcctggagatgtcatccaagccatacaccgatatcaagtcctgtagaggatttggttgttggtacgtatatgtagtttccggatccacgtaatagtagtatgaggggactgtagtttcgtccactctagaagccattattatcgtattcctttttcgttcacttactattgctattcgcactcactacagatctatattttatgttccaccctgttgtcagatcaggaaaggaatgaagaggctctatttaaaccaaatacacctcttcgtttctcaatattgttgggctttccttttttttttccttccacgtctatctattgtctctatcaaaattaggaaaaagaaatgaagaacgatgagccaaacgaggctgagacaatcatgcatccgtacattctatgtatgtttgggtgtatctttccagattcggttctttttttttttcagtccaattgaaaaaaaaaaggaacaggaacaacgggtcgaaatttgccgtcacattcagagcgaagagcgacaggggaattggtgggctaaccacctgttgagcccagctagcagctgtcggtaaaccgtcgttgggcggggcgcgacaatgcagccagcggaggcattgtatggtttccgtctggagagtgggcttagccggcctggcactccttctctaagcagagtgagaagggaatctttttactggagaagagtgtttgattccagcagaaggtaatacgcacctttctcatctatttgcagaatcgttttattaaaatacttttaaagaatttagattttgataattagttcattctcttttacaaagataatcaccaaacagggacaatacactgaacgataaaagtatgtgacatatagaatgctagaatgaatagcctagactgcattgttatgagagcaacgtttgatatttgtggcgattggaacaaacatagtacatgccaaaatgagatgaaatgtccaatttgaactgattaacatacacgcgcaagctcgtatttgtttactggtacacctagagttagccgatcaaagagacagtggcagatatatgggaaaattttctccggaagattgcatgcgagagtctcataaccagtcatttcccaagatacaattctcggagctgttatactaacaaacttttaattttcatttttttttttttttgattagatggcctccttacctcacccaaagattgtcaagaagcacaccaagaagttcaagcgtcatcactctgaccgttaccacagagttgctgaaaactggagaaagcaaaagggtattgactctgttgttagaagaagattcagaggtaacatctctcaaccaaagatcggttacggttctaacaagaagaccaagtttttgtcaccatctggtcacaagactttcttagtcgctaacgttaaggatttggaaaccttgaccatgcacaccaagacttacgccgctgaaattgctcacaacatctccgctaagaacagagttgtcattttggctagagctaaggctttgggtatcaaggtcaccaacccaaagggtcgtttggctttggaagcttaaattaaataaagatttacaaaataataaccttcatttaattttaaatttcaataaaaaaatatcaaatcaaacatgacttttaaatctaccattagataattgtataaagtgatttattgttttttaattttgttttcattatctatcaaaactagggcattcttcctcacttttagtgataaacttttgtaaactcagtagtatatccagccgacgagcaatgcgataacggtgatgataagcaatgctctggaactcagactttgcccgttacctgctgatggcgctcttgctgattctgcatcgtggtttccagacggttttcttttcggtaacacggagtgaaatattttgatcttcttgaagactatgtcatctttgtactgctcttccagattaggccaatcggacaacagctcgccatcctccacgttttggtaagctgccgggataggaagtgtaacgatcaagaatttgtctcgtttttggtccatttcatcgtcagcggttgacttgggtaatccaaggaaaacaatttggacatttacactttcatgagcacctatgatggccacattgggcctcacacaatactttgtgggagcactagtcctcactttaaatataactctcttttcaccatcgttctcgagctttatatactctgttgattgtttattaaggggagctgaagtattacatattagtaacctgttgcatcgcaccaaaaaaggtagcaaagtttcccgcacactagcaattctcgtcaaacatacccttgaacaccagcttttctggcactattctcattgtttactcgtctgaactagtgcttatattatctgtcgtcataccactgtttgagacccccataggtcttatataaggtaatgcatcattctaaacgggcggcaagccatattaaactatctatataactacaacagtattcatatacctagtgaggaggccatttgaaagcgcattttacctcagtagtcatcacctttcgaaacgacttcctttttgtgagcatgcaacaagatggtgtgttcgaattgtgcagtgtaggatccggggatatcgttcaatggtggataatcctgtactaaaccgtgtctaaccaagttattcaacgcaaataagtatttctcttggccaagtctgtctaggtatcggcgacagaacggtaaagtcccaaagttgcggtctatcgtttttaacaagttcttggcgctgtctaacgtgggcattacctgatggtcttcagcagatctggcataatgagaaacttccccaccggcagtaacataacctctaccagtagaaccaaaagtttcaatggcaaagtgctcaccttcctccatttttgtagtgtccccatttttgacgatgggaacggatttaccgccgtggatacgatatggtgcgatactgtggccacatagattacgacaaggtttaacctggtaagtctcaccattgatttccacttcgtaggattccataacttcttggatggcttcaccgatgtcggttaatctcacatcgatacccgcttctttaatacccgtgtaagtagcgtcctttacagcggctagcaggttatcgtattgtggatcaaaggaaacagtaaaggcagaatcaatgatgttaccgtttacctgcacaccataatctaccttcatcacgtcttcgtatttcagaacggttttgtcgcctgcattgggtgtgaaatgtgcagcacaatggttgagagagagacccgttggaaacccaataccttgagatttgggatcctccatcgctaataaattttcggcacctgtatactttcttgtagtattttcgatcatgtcagcgatatccattaacttcatcccaggaacgattctgtccttgatggcccttctcacacgacgatgtatctcagcaccctttctgacatcattccaatgttcggccctttccagatcccttttcaaataacgtgattcttcaaccgtggttctttgcagattgaaatcttgatgatagtccatccacgcaccttctgggtactttccatctggaaacagtaattcaatcttcttcacattgcttttcttcttcttctttttcttgttcttcttctttttgctttctactgggtctgactcgtcagcttttgcctggtcttgctgttcaacgccttcattctccaaattcaattcttttaaatcagaagcaggggaattttctatttcagcgtctgtcatttttcaatacggtagagcttctacagtacttgttgatgtaaaagcccacttattagcttcttgctatggcttcctttcttttttaagttcgcttctttcccaagattgaaaataaaaaataagtgagaccaggtcattaaaggtcccttgaagagtaaaaaatctgtcaaatatcacccataagagcataaccataatgttgaagagcacgctgaggctttcaagaatctctctcagaagaggtttcacaacgatcgactgtttacgccaacaaaattcggatatcgataaaatcatactaaatccaatcaaattagctcagggaagcaacagcgatcgtggccaaacctctaaaagcaaaactgataatgcagatattttatcaatggaaattccagtagatatgatgcaatctgctgggagaataaacaagagggagcttctatccgaggcggaaattgctagaagtagcgtggagaatgcacaaatgagattcaattctggaaaatctataatcgtgaataagaacaaccctgcagaatcatttaagagattaaacaggatcatgtttgagaacaatattcccggagataaaagaagtcaacggttttacatgaagccggggaaagtggctgaattgaagagatctcaaaggcataggaaggaattcatgatgggcttcaagaggttgattgaaattgttaaagatgccaagaggaaaggatactaatcgtaccatcaactcttgaatattgtgaaattttcgccattgatttccgtctttgtaaataggtaatgcgtaactatttagttaaatttttgtatattttttattctatgacttcacttatccattatttccatcgtcaaaaaaaggaaataaatactgttgctcgaacgaacagcaagataaagtggaaacgaaaagtaagcagcttcctcaatatgccgtcaaacgtacgttcgggagtcttaactttgctccatacagcatgtggagcaggcgtacttgcaatgccgtttgcattcaagccatttgggttaatgcctggtctgataacgctaacattttgcggaatatgttccttatgtgggctgctattacagactcgaatagcgaagtacgtacctaaatctgagaacgcctcgtttgctaaactcacccaactaatcaatccgtcaataagtgtagtgttcgattttgccattgctgttaaatgttttggcgttggtgtatcttacttaattattgttggtgacttagtgccacagatagtgcagtcaattttttatcgtaacgatgataacatgagtggttcgcaagagcatcacatgttcttagacaggcgtttgtatataactctgatcatagtgtttgttatctcccctttatgctttaaaagaagtttgaattctctacgatatgcttctatgattgccattgttagtgtcgcatatttatctggtttgattatttaccattttgtaaatcggcatcagctagagagagggcaagtatattttatggtacctcacggagattctcagtctcattctcccctgactacattgccaatttttgtgtttgcttacacttgtcaccacaatatgttcagtgtaattaatgagcaagtggataagagcttcaaggtaatcaggaggattccgatttttgccatcgtgttggcctattttttatacatcataattggtggtacaggttatatgacatttggtgagaatattgtaggaaatatcctcactttatacccgaattccatctccaccaccatcgggaggttagcaatgctgctattagttatgttagcatttccattgcaatgccatccttgcagatcatcggtaaaaaacataattatattcattgaaaatttcagaaaaggtaagttatacgataacagagctagctttattccattagacaactttaatagtgaagatccgcaggaggcgccaacccaacaaaacaacgaagagccaaatctgcgtagtgagtctttacggcatatcaatattatcaccctttgtatcttactgttctcatatctactggctatttcaattacgtctctagcaaaagtcctagcaatagttggtgccacgggatctacgtcgatttctttcattttgccaggcctttttggttataaattaattggctcagaatttacgggcacgaatgaaagagtaccgacaagcataaaaatattcaaatacttaagtttatctctattcatctgggggatagcagtaatggtagcttcactatcagcgattgtatttttgggcacatcatcacattgagtttgtacattacttttcgtatttctataaacaaaaaaaagaagtataaagcatctgcatagcaattaataaaaaggtgaccatcccatatatataacactcaaatttgatggatccgtggcttgctgaatcaaatcttgtacgctagactctacacttagtccattacccataagcttctcttctacacctttaagggccctataagactcttggttttcgttcctgtcgttgttacttatgaacttgctgacgttatcgaaatttgtaatttcatgttcttcttcaaataagtgttcgtattttttaactggtgacattacccaggaataaaggggatcccattttaagatattcaaaacacacatcaccttgacataatcttttcttaatactgcgtaaactctttcacaactccgcctgaataggccatccacgcctgtgactccaaatccatcaacgatatctctagttaatctgaaagggaccaactctggaatggggagtaattttccctgatcaaacgcaattcccaggtctatatgaataggctcccctgttgagcagtcaagcaggatattgtttaagtgcctatcaccgaggcctaatatgtatccaacgatagagctagctgcgacaccttttgtgtacgttttcttagcttcaaaccaatccaacggatcgggaaaggaatcaaaaaaaaagtttcttaactgcggttttatttcattagtgatttttaaataagctttcagcctctcttcatttgattttgtttgaactgctttcatgccttttcttgcctgatcgaaggttatcttatcgttggtatgtagcttactcaaaatttgatgtaatgatgtagaatttgcgacaaattcaatgattcctgcctttggtcctaatggaaccactttgtatgttctaatacccagatctagatttcttaatactttatcattttgtagaactttattaacttgttgaaacacttgttccataattgcatcttgtctcaaatcgtcattacttcctttcatcaaagctttctgcgttgtaccatctgagatgttgaaggtgactattttcggcagggacaatcctgtggtagtaatgcctactgtttcattgacggatacaatataagggcgggcttttcttccatcagcagaacttttgactgtaaaattactggtcggtaggggaagcttctccatgtttagctgtttcagccaatattggccaatcttcaaattagctaagcgtaacgtcttcgtattttgcacaaacttaagattagctaactctacagacatctcgcaaaactcttgcacaggaagtaaatactttttcgcaaaggcacccctgtcatatccttgcaattctaaaagaatctttttgacagcttgaattttttgggatatgttggtgtccttattggattgcttttcatatagtagtatgctcatcactgaataaagggagtcatacggtagtttgtaaagaagtcgtttcatggttagttgcaatggcttttgaaattcattctcctccatagatatttttgacgcaatctgattgacccagggcaaaaacttccagctcggtattgttccaatttctttatatagtaattgattgatcttgctattgtcatcattctcgaaccataaaccacaaaacttatcaataatgtcattatcatatctgttgctgaaaactaaggtattgagatagaaatggagtgcatgccataaaaatttttctttttgaagaagcagtgcctttagtacttcagaatctctattatattgtagcaagacacgattataatgccttttcgcatcttttctttcattttctggtaattttgtgtttttatatatcagctccaaagctttcaaggtagattttccagtatatgacctatgttctctatcttcgatttctccatttgatcgtaacttttgtgcctgttcatccagaaaacttccgagtgtgtagaaaacatcagaacatgattcatgatcttcgacatttatatcccaattgacaatgattttttcatatattgcagcagctggttcaagccttgattctgagctccatttaactagtcgagctttaatttggtccataggcacattaatgagtagcttaaaatcgtcataaaggatactttcgctaatattcttctcattttgagctaaaagatctctcattatcattacaggtgccttgtactctcgagactcccagagggcattagcagatgtgaaacttgccaatttctcaatttgagatactacagagggatcatcgtataattttgcaatattcttcactgttttgctcattagagtggcatttcgtaacgcatcttgaggcgcaccattggcaattgccagctgaacgtaattagcaagctgaataatggatccaaggcgtaaatatttcgagcattttacgttttcatctaatgaattcctcgagagcacattcattaaagtatgtctactctttaacgttgttttgtgatcatagaagtctattgtattaagtctctccttatcggccttcataatagacatcaatgtttgggggaaggaagtaacgtcctgagggattgctgctatttttataaattcaataatcgcgttcagagtatccatccattcagtttggctaataaaatgttgtcgagaatcaaaaatagttaataaggatttttctaaacttttttcagcaaaaccaacgtcctgtggtaaattttttatggcatagtataaacctttggctttggaatcaacaacttttggagtcaatagcttccagtctcccaattctaaattccatttgtagacatcactggatccagaaagtctactttccaataagcttgtcaacccgtagaaaccgctatcttctgtggccttgattaatgattccttttcctcttctagtgaagtagtgtaattggcatcaaaatcggcgttgttgaaaagaaaacgtttccacgtatctgagtcaattctattgatagagttcaaaacaccctctattgagtgtggaacaggtaagcctgctagaaaatcgccgtcatttatgcattcgtaaatcttctgaagtgtatttatattcatttctcttatgtttggcatgttcatttcctcaaataacaaatagccaaacttgaactcttttattttaagagaaatttgacatatttcttgtaaatctaagctagaatatatgcgcagacagtttcgttccttgcatctagaacccatcctaatcattttaattacattgaaaagcatctttagctttatctcagaatctttaacatgcagcaacattgctatttgagtgaatattcgattgctccaattcaaacagcttttcggatcgtaagtcgttgaaagaaaaaagaggtcagtaagtactaattcacaaaaagctgttgatcctttgcataaaggatacaagcaaacaataggaggtatattaaatgatatttggtgaatcaaactacgggcgaatttgcttagccagcagttgtagggttcgttcactgacaaataagtatcgcatatgaatgattccatcccaaaattgtttgccaacgggtatatagcattcagtacatccttgtccaatggagcaactttatctttgttctcgttcattatgttatccctaaaacaaaattcactttcgctatttcctattgagtagcccactaggtacgttagaatgcactcagaaataaaaaacacttcagtagaatcatataactcagcttctttattgaaggtcgaaatacgttggtatatcatatgtggttgttcgggatggcgaaataccatttcaaagtttttcaaatgaacttcattattaaagtttgtagatctctctctttgaacttcttgctgtaaaattcttcttgaaagagcagcgaaccatagtttgaagtttttactcaaatattcctttggaacatggtgtttcaaaatgttaattgcagcagctttagaaagcgaacaaccgatttttgaagctaccggtctcctggcataagaaaagagtaaagaaaccaatacaacatcgtctacgccacaatcactagcatccaaaagttccgtattttcataaatatcatcttggactatatttccgaatattgcatcaaggaagtatttccaagtttttattttgatgagatcccgatgctctaaaagctttatagcctgctggaaggatggactgagctgtttgttttccctcaaataaatgaatattttgcaaaataaattgggcagagatggctctatttcaaacgtatttttgtcagccagatttaacaatgagctgaaaattgttattacttcatcgtgaatttgtgtatctattaagaattttgaaagccgaattatgatgaagtttaaagttgatgattttacaagtacattctcatacaacacaaaaagatattttaactcccttgcacatcgcagttttcctatgtaagtcgatgtcttttcaaggtctgtaataaccgataaaaacaaaagcttgaattcgtgtgtgttgttcttttcatgagcaaactgcgtctgaactaaggttgctcctaatgccaagggtatatgaagtgggtattgatacctcattgaaacactggaattttcaaataaatatggcgaaaggtatgaagttgggaataatttttcaacagtagatctaagttcagtaagtgagcccaaatcagtaaatcttatgatccactttaacatcagtagacggtattttttatggtattttactgttgttttacctgatatttggggcaatatatcaaatattagttcattcacaccgccactgataaaggcaagtggaatacacaagtaatagctgttatccaccagataagcatcaccgtttccagtaatcgcgtgtaacatgtctaagatccatttttggttgaaaccttgagaaaagtagattgcagaaatttctacaaagtatcttcctaaaaattcatgaatatcggcaaatccaaaaagagatatatcccattctttctccaatttagaagtagggacttttgttctgttaaaccagtacataatcaaatcaaacttacaatattcgaagagctctgtaaggttttggtagcgaaaagcgaccgtaattttgttcagagcttgttggataaacgcacgagtatgattgaagccagagtatgtcatcatatcctccaaagaaaaaactaagcttgggtaagacaccaaagacaacatggacattgcaagagagtagaaagcggacttttcaatactttgctgaggcggaccaaataagctcttaatctcataaaatatgatactttgattcttatagctcacttgggccatataactcgaaatactgttcattatgttaataatattggaggagtctagcttttgcaggcatttaataaaagttgcaaagactctctgcttcccacctctgattgatccgtgggaaagatcatgattttgaagtaggctaagcagcagcatagaaaggttgaccgtaggggccacaccagtgaaagaattgtcctcaaatctagatatgatccagtccaggatatcattgcagtccgaattcaaaggctgctcggggtaagataaccattgaggtcttattgcttcgatataagatgtaagtaaaagcatagcttgattggaagaactatagtggttgcaaagcaatttttcacccaagacttcagtgaattcttccaggattttgttgtaagaagatttctccccgattgcttgttttaaccactggcaaacagtgccaagataagatataaatacatctgtgctaacgcaatcagaaaattccaatatggctaccaaacgctctgaaatggatttatttcttgaagaccataggtaagctcgcactgctttatctatagtggagtgcagaggcttctgaaatctacctccaattgtgtacggactattattctgggtagtgtcttctgaagaggcttcgaagtaattgatggcagaagttcctgtttgagatttgtttttttgcatcctgataaaatcattaacgatttccttcatattaattttgtcaagcactaaatggtctacatttatggtccgtatcgataaaacctcctcaaaaaatgattggtaggagttttggctatcaaaactaagttgtggaatagttattaaggttgttctcttatatgctgcaataaactcagaaaaagtggaatctccacaaagattatcaactatttgtattaattttgctacccaagtaaatttttgtagtggagatgaaaatgcatcactttcaatattttccagtaatctgtaaagaatttcattataacgtgtgaggtctaaggaaacttttggtaaattaaaaaagggagtgttaaaacattctgacttttcttctggttttacgcctaaaagaaattccctctgctcttgaaaatgttgccaaatcttgtggctttcatcccaacatagtgagacaggattagctccttcgccttttttatcgttgaaagggttctctgggtcatatttgttacctaaccaggatataaaattgcagaactgatcctgtttagcatcagttccgcgcaactggttccactttgattttagccactcaaaaattctatcagcggacgatataccgttcatagattggaagtctttaccaacgtactgaaggtatccccatagcatgaacgattcattagtaactaatatgggacccaaaatatcggataattcgtaaagatcatatatctgattgatagttttctcatcggataaaagctgctttgaaaactttatggagttggctaataaaagacaacttaactggcaagattcatttgattttactaatggtaagcaaactttaaataggcgtgccatgtcgccattgcttaattcgcattctttttgggataataaaggaataaaagaaaaacaaacccaattaaagcattggattttttcgaattttgaaaacagaagttctttcagctgttctgcaaaacttttagtgaagtcttgtaaagttccataaaatgagcacaattgtaatcctagcacttcaaactcatgtgagctgttctcctctaaaagatgaataagaaatgtgtccatatcgtcagaaatccgtaggatagaaggtatatccgaatcacattttcttcttttaaataataatgagtaattttcattttttctgttcaatgcaaaatatgttaacaatgatttggtaattccgagtatttttaaccacaccgatctgcctcccctatctctaagtctaaaatcaggtaatgcaaaccatgaatttttatcccttgaacctcgaatatatgagaattccacatggtttacggtaaataattgaggcttataattacttaagcgcagtagaatgtactcacggtatagagatacaagagattcggaccgaagctcttcaacataattctcttgaccaatcatataaggaagtttatggttcattagttcacttgacataacatcaaacagtgataattggtcttgtactagctcattggaagtacagccaattgtcaggttgtaactccatgcttcttttataagcattagcgtatcaataacactaaaacaatggcacttcaaaattaattgatttattaatgacattattaatctcgtatttccattttcttttttgctgagcctcaaaaaatctattacggtccaagtaattgtccttgtcacttgaaatataccaactgtgtctaacgccaataaattcaggaggatcgatatgaaattggtcaatgttttgtctaccatagataatttcatttggctttgaaagtactcgcaaattttatcgactaaggatatccattggtgtatcatgaatttcagtttgaaagggtcacttttaattagggcatccaaagcaaacgataaatgtactgaaacggcatccaataaacttttggaaccatctttgaccattaattcaggtactactgctaaaagtaacttcaacgttttcactttaaatctctcacatgatttttctacaaataatcttaaaacgtacgatatcgtggagagtctgttctcactaagtgatagcttgtttgtggttgacactgtcaagtttcgaagaaggtcacagtattttgtgtgttcagatgcaagtaactctaccaaagcttctgccgttgtagatagggccttggttggtatcctttccggatcttcttttaaaattgttgttagctcatctaaagcattgtttctctctttgatttttgttgatgatagaaagtttaaagtttctacaatcccatgatcctccatcgtctatgttacactgatttcccttttctttgaaggcttttttttcgaatttcctgctttttttgcgaggctttgagaagtcaattagtcttgattattctattaacttggaactaatttaccttgaaaaatgtcaaaatatgcatattgtacggctggtgccatacttgtttctcactagcaaaacattctatcatctgttattcttaccttcttaacgtgtctgtttgcttttttgacgtaccccaaaaaatatatagaccctcctatcacgctcataatatcatgtgattctctcgatgaacgataatagtaatattttcatctaaaaatgcaatgaattattgagtttctttaatctgtttaagagattgttatttataaagaaaatatatataattgaagaatctaagagtatgagtcaaaataatttcctttttacacaacaacaccggagttagatgcaactcttggccataaatcggcacattccttaccgactggaccagtgatggcggaacccttcatttcacccttaggattagcgatgacaccagcattgtcttcgaagtacaaaaagacaccgtctcttcttctccaagacttagcttgacggacaacaatagctggcataaccttctttctcaattctggcttacccttcttaacggtggccataaccatatcacctagagaggcggctggcaatctgttcaatctggaaccagagcctttgacggcgataatgtacaagtttctggcaccactgttgtcagcacagttcatgatggcaccgactggtagacctaactagttaaaaaagatctcaatatcggggagtgagaataattttgttagtaaaagcatagggagaaagttagcagatgtggttaatcttgaaaaatagagttaagcgtgatttttgtagaaataacatttcgatggttatccattagtatgggcaaaagagggagttaggatatgcttgccgtgtatgattttgaaaccagaaatttttgagtccatgaatattgacaggtatcacttcatctgcaaatacagcccgcttaaccatttaaaaactgaatttatgtgtgtaattgcatctttggcggggcggtaccagtgatggcacatctaccattcttatggaaaataacaccgataggtatatgatcaggcttcacacttagtgtttagcgtcttttaaacctctgtttaattctgttgtacccagcaaaatgaaatcttggaactttactttatgatcaatttaaccaaattgcattgtggaaaataaaaattttaacatactgagattctaaacttagtaccttgagcaccgttaccggacattattagttatatataggtgtgttggttttgtattgcttgtaagacctaagagtcaaaataaagaaagtaagagatttttagctactaaccttagcaatacgatggtattactattagcgggaacaggtacattatggctacagttcgtttcctgccatattaatttttcagcccgagcgtgtttgggtttgatattttcttttttacctctttttcaacatttccatgcaagtctgatgacggttgtacggctcgttctgtgagccggataagcgataaaaaaacttggtctgttgaaaataataactgcatgggttttttcaaagcagttgggggtgtacagatgttaatgtagtctgatatatgctctgtcttgtctttttatctgggggatcattaacatggtaatagtgattggtattgcaagcttaagattataattacataaaacaatacaaatattctagcccgatggggttattatagaccagtttttgttttctcttattctatctgttaaaaagtccgtggggttattgtcttcgacagagttattatccttgtcgctccctttatcattagccgtattttcgttatcctcgtcattatgagtcctcagttttgcacgttgtgctcgtgacatatgactccaattctgctttttctccaaatactctcttttgcccattgtgctgtagccgtcatcgcttggatttggaggccaactacttgccttgttcccaaggttattgccataatttggattgtagtactcttcttccatttcgttcaatctcaatgcctgtaaatcgattaaatttatgcccttctcgttcttagcccaaccgtttccgccttgtaaaatatcttccacgcattctcttggcgtaaattcacctggtcgaggatcccacggtaatttaaacgttttctggtacaagctctcaatcagtgggctcatagaggaagatattgttgttgacagccctggctttgttgtcatttcgctactcttgtggttggtagaagtcggtgatttaatacttgtgctgtttcctgtcgcatttgtaccgggtttcgctacagttgttccaataccgttaaaattggagaatgtattcttgggtgacatctggtttgttgttgatgtggggctagatagttcagacgtgttatccagtatagtatttattcctggcctgtaattagcgagctggccattagtaaacgatttggaaatgttgaaatcttcgtaagagcctctaactagcttcaactgcaatgagacgttgattatagaattgacctttgagtgctttaggagaaatctgtttgttgtgggagtttcgtcttctttgacgtattctgttatatctatgtctactgttcccaatagaagtttacccgttatcttttgagaatatgaattgtttcctgtggccgttagtgcagtggcgttagcataggtcgttttcttcactttgccattgggactagaactagaagtcaacgaggaattcgcatcagcaaactcaaaaaaaacatccaacaccaaaattttcttcaagaatctgccgtttttatccaagtggagcttcaccaggattggtttgtctaatgaataattccattgtgctctatgatgttgcacatgcacgtgttttgttgtacctctactctgggtcgaagtggtttgatgctcaccgtccagagccactttgtgtcccgacgtacctgttccatccttcaaacgccatttcgtgtagcaatagccagaagattgaggaatatttaccaattctttgatttgcaggtccagtagaaactttggtctttttgccttgctattatgattaaatggcatcttaatattttgtgagcggtattatacctttcttgggtacctaatacttctaagcaacctgaatgaaattagaaggtgttcactccttcattagcaagtgagctttgccgttgtcaccgtacttggtcatcttaagagatacaaaggggggggaccctgagaaaacttctcccgaaaaaaaaaaaagaaatatacccacgcgttctttacccggaaataaatatcttgatttagccgccgagattgttatatatgcatccaagacctctgaatggtggctaattaagacacttaactgattacgtttccatcaactgctatcatgttcgcaatatttgggcaagaaatgaaaaagaaaagttaccaactcttctcccttctacgagcggtgaatacatgggagccgagccgcatgaagatgaaagtaatattaaaattaaagtctctatcgaagcagtgactctctccctatcagccggtaaatttttttaacgaagtggagctaaattatcagaaaacgtagagctggtatgctggtagatctaaacgaagtccagtttacatcaagatgatatcgtgcaatatttactacggcatgacttaacagtacagtcatgatttaggaatttgagtgttctccggggttttgcagataaaaatttgttttcttctctgccattcctggagattttgaaaagagttggtaatgtgtttcaaaagaaaaaaatacattccaagaataaataccaggatttcgtgacaaaaattaaaaaaaagggaagtatggcatgcctagaaatcttttctggaaaacttgaagcatatcatataattgtatgaacttgtccttcaaaagatgttaccaaatattcaagagtatgtgagctttctattctattgacgcgtaagaaaggctatcacgtgtgggggggagagctcagccacattgcactactttcgaaaccgcgtagtcggaaacgacattcccccgtaccaaaacaaacgaaaggacgtgaaaggtaaatgaataacatggcactaaaaatttggcagaaaacgaaaaaaaaaaggaaaaagaaactgaaaactatacgcttcccttaggatactttctgatttacatccgaagaattgggtgcgtcaattaaaggcaattcttcgctctatcaagcagttttactgcgtctgtctaaagaaacaattgttttactgaatttcaacaaagttctaactcgaggtgaccggaggccactgtaataataaaaaatagaagatgagtctcgaaggaaataccctaggcaaaggggccaaatcttttcctctgtatattgcggtaaatcagtactctaaacgaatggaggacgagctcaatatgaaaccaggtgataaaattaaagtcattactgatgatggggagtacaatgacggctggtattatgggcgcaatttgagaaccaaagaggaaggtttatacccagcggtatttaccaaaagaatagcaatagaaaaaccagagaacctgcacaaatcaccaacccaagagagtggaaattctggtgttaaatatggaaatttaaatgattctgcgagtaacataggtaaagtctcctcgcatcaacaggagaacagatatacatcattgaaaagtacaatgagcgatatagacaaagccttggaagagctaagaagtggttcagttgaacaagaggtatcaaaatcgcccacacgcgtgcccgaagttagcactccacagttgcaagatgaacagactttgattcaagaaaaaaccagaaatgaggaaaacacgacacatgactcgttattttctagcacagcggatttaaacttaagttctgaatctttgaagaatataagtaagtcaaatatatcaacaaaatccctagaaccgagttcggaatcagttcgtcaattagatttgaaaatggctaaaagttggagcccagaagaggttactgattactttagcttggttggatttgatcaatccacttgcaataaattcaaagagcatcaagtctccggaaaaatactactggaattagaactggaacacctaaaagaattggaaataaattcttttggtataagatttcagatattcaaagaaataaggaacatcaagtctgcaattgattcgtcgtcaaataaactggacgccgactactctacctttgcttttgaaaaccaagctgcccaactaatgcctgcagccactgtaaatagagacgaaatccaacaacaaatttcctccaagtgtaacaagttgtcaagtgaaagctctgatagaaaatcatcttcggtcaccacagaattgcaaagaccaagctcggttgttgttaatcccaattttaaacttcacgacccagctgagcagatcctagatatgacagaagttcctaatttgtttgctgataaagatattttcgaatcaccgggaagggctccaaaaccaccatcatatccaagtccagttcaacctccacaatcgccctcttttaataacaggtacacaaataataacgcaaggtttcctcctcaaacaacatatccacctaaaaacaagaacccaaccgtttattcaaatgggctaattccaaattcttcgacatcttccgataattcaacgggcaagttcaaattccctgccatgaatggtcatgactcgaactctaggaaaacaacactgacatctgctactataccttctattaacacggttaacacagatgaatctctacccgcaatttcaaatatatcttcaaatgctacatctcatcatccgaacagaaattccgttgtttacaataaccataagaggacggaatccggaagctcatttgttgatttgttcaacaggatttcaatgctatcgccagtcaagtcaagtttcgacgaagaagaaacgaaacaaccttcaaaagctagcagagcagtttttgactcagcacgcagaaagtcgtcttacggacattcaagagatgcctcactttctgaaatgaaaaagcataggagaaactcttctatattatcttttttttcttcaaaaagtcagtctaatccaacgtcaccaaccaaacaaactttcactatcgatcccgcaaagatgacttcccattctcgttctcagtcgaattcctattcgcatgcaagatcacaatcttactcccatagtagaaaacactcgttagttaccagccccttgaaaacttctttaagccctataaattccaaatccaatattgctttagcgcatagcgaaactcctactagtagtaataataaggaggcagtatcacaaccaagtgaagggaagcacaagcacaagcacaagcacaagagcaagcacaaacacaagaacagtagctccaaagatggctcttccgaagaaaaaagcaaaaagaaattatttagtagcaccaaagaatcatttgtaggaagcaaggaattcaaaagatctcccagtgaacttacccaaaaatctaccaaatcgatacttcccaggtcgaatgctaaaaagcaacaaacatctgcttttaccgaaggtatacgctctatcacagcaaaggaatctatgcaaactgcggactgttcaggctggatgagcaaaaaaggtaccggtgctatggggacttggaaacaacggtttttcacacttcatggaacaaggctttcttattttacgaataccaatgatgagaaggagcgtggcctgatagatataacggcacatagggtcttacctgccagtgatgatgataggctcatttccttatacgctgcgagcttaggaaaaggaaaatactgtttcaaattggtccctccgcaaccggggtccaaaaaggggctaacctttacagaacctcgcgttcactattttgcagttgagaataaatctgaaatgaaggcatggctgtcagccataataaaggccactattgatattgatacaagcgtccctgtcattagttcatatgccacaccaacgatacctctaagcaaggcacagacgctattggaagaagctaggttacaaacccagttaagagatgctgaagaggaagagggaagagatcaatttggatgggatgacacccaaaataaaagaaattctaattatccaatcgaacaagatcaatttgagaccagcgattacctggaaagttcagcatttgaataccctggtggcagactttgagaactgcaatcattagttacttcttgaccaacttaaacaccttaataattaatatttaatagaacataatatagtgatataaagtatataaaaataaaaagtttacgaattaatacaatcaaattagacactgatactatcaagaagtacatcgcaggaaccgcagacatgatgtcctcttctttcaaattactggatatatatattattattattgttaccattaacgttattattattaactattactattacattaacttaaaaataaatatgaaacaacgaagaacaaaaagaattatgaaaacatttaacatgtttcaatttgttatgttttggccaacctgcgtttattcttgcatatgacatttttgtaattcatcgatgataacttggttaccctttggatccaaattcatagcaacagttagctccttgattgcatcttttttcctcccaactattctatatgtttgacccagcaaataatgggctgtggcatcatcaggaacgagtttcaccaattcttcaaaagtttgcaaagcaacattatatcttgtcatggaatagagcaactggcccatcttatatttggatagcgaggaagtcggttgcaaatgacatgctagttcataatattgtagagccttttccttatagcccagcttttctaaagaaccaccgcaacaacagattaacacaacattgacgggattaattgaccttgccttttcaaaatataacaacgcttcttcatattgacctaatttcatagcgctcgtacccaatccgtaatatgcattgtaatgctgaggatcacaagctagcgcctttctatagcatgtcttggcagaatccgaagaatcgttggaagaatgttcatgaccttgcaaagtatacgcgtatgcaaaatttgggtctaactgagtagctttttcgaaggcttttattgcggcatcatgatccttttgcaatgatagcaaattacctatacaacaccatgtttcgggcttattaggcattgtatccattagcccatttgccaaatttgaagatttaaccttgtcatgcaaatgccacagcaaagtagaaaaaatttccatatcttttacccttgccggttgtaggtctttcaatctattgaaatactttaaggacatatcataattaatgatctcaaaatgaagttttcctaattgcactagacaccatggcattgtgtctttaatatgagatgggatttgagactcgaacagtcttattgccttgaacgaattgtattgtgatgacgaccttaatattaaagcgaaattatacatgatttcaggcagcgtaatttgataatcactcgttagtattgagttactgattattaaagaccttggatttttcttggaagttgttaaccttcctgttgaggaatataggtttcttggagttttgaaagttgttttatttataatgttattattattattattattattattattattattattattattattattattattattattattgttattttggtggttcctatcgttatttaacagtttcgatggaggagtcgttaaaagtttgtttctgttataaactttggccaacgagcttattgtaggctgtttggaggatggagacactaagttcatggaaatgttatttggtagcgcagaagacgtcttactgttgattgcagggtttttaggagtttgagtatttttgttctggcaggtccttattgatgtgttcgcttgttgctgctgtgaccttgagaaatgctgaatggaagaaaaagaagatgccgatgtagaagggggagaattagacgactgaaacagtgtattaacattattattgatattattattgccgtttttgtttgtttttgaatataagctaggttgtgaacgaggttcgaaatgcgatagtgatgtagacggaaacgatgaagctgcattattattatgactattactttttttccctgcaatgtcgaaaaaaaccctcttgagatccacggtagctctcattttacaaatcgcttcgtaagattcccaaaggtaaggattaatggctaatgcttcagaatgataaaatgctccctccttagaatggtccagtttcatataaagattgcctaacaggcaattcaaagtggccaaatcgggaatatggacgagattagaattcaacaccatatttatgcgcgtattactgctgttcgaagaaaatacatttattattgagagaagagtgaggatagcttcgttaactccctgcgaaagctgtaaagcacaacgcccgaatatgtaagcgataccaagatgatactccttgaattctttggatatctggaacgcagtgtggtagcttttattcagaaacagcgaaagtgcatataaatataccgcatcggaccagtaaacacttgatttatcgagaatggagcattcagcatagagcagttcggccaaaaactctgcggtactgtagttcaactgctgaatagcctgctgaatgcagtcctgaagctgtatgatggtgctcaaagcttgatcatcaaagctggggattcctctcgagagggtgaacggtgctaactcaggatttaccgccatgctatttttattatgtatcctgcacgaaaagttcgtgtcgatttatgaatagatatgcagtcaccaaaacagagtctaaaactctcacagctaggtatggttttttgataaacttttctgtggcacctttgcttgcactttgatccttttggtttactttcagcctgttccatccttttgatcaaaaaaaaaaaggaaaatcaagcgcgggtaataacggcaccattaaatactagtagtactatatagatggtataaagaaatgatttaaaacaatacgattatatgatatttatacatctgtttcagttgagctttttttccatagagctggtggtacgaagatggcttttggcgagggcgaccgaaccagatagctgcgtcaaggccaatagaagcaacagaacagtattcaatgccaacaatagcgtgcttgcttgtgagtttggtggataggaattccagcaccactcgtgcaagacgtaccaaatgggaccaacgaagaagggcattcccgaccaaaagatcagtataggcaaagtccagtgataccaggatagaaactggtagtggagggaccttgaaaataggacgccgatgaagttggatgcgattagaacgaatggaatagtcttggcgggattggcattgagcactgcatttttcctcagcggatggcacagggaagaccataaatcgggcaggatgcgagggtatcttgtgacgaacagtgtggtgagcgctatcaggtggctgattaaaagggccaagtggaacctcttatcattgaaagcctcttcatccatcatttgccaattgatactccattggtacataaacttcctgccgaaattaaaagcgcaatgcaggtactgttgcggaaagctgcgcaggaagggcactgcaactgcgacttgccatgcaatcatcgcaacgagatccaacaaagtaaggattacgttcgcgtcattaaggatgaatagagaaatcatcattgcagggaaatacaacagcgcattcatcttaatgctcacagccatactgtatgttgcggagatcaccagcgcaagggacttctttaatttggggcgctgatggcacctgctggccacgatagcccccaaaaccgtgacgaccataaacaaagtagtgaagcaatcattgaataaccgtagcacgtaaatagagtgcaatcttttagagaggcacgccaagaccacacaccacggtggtagatgtaaaaggtagtaacacgccatttgtaacgccagtgtaaggagatacaagtatctgaaaaacacttgcccgcgctcaacgtggtccattccctctgttagccagtacatcatcttgtagatcaagacgtggcctgctggatacaccagcgggcccgttccaccactcacctgagagtagtccagcatgccatcgagctgaatcatctcgatctgctccatgtacgccttgtaatcgatctctgtgtaagctaccttcttaatgataatcttgcacagcatgctttcgaacaaaatcaaaaggggcataacgataagattggccctacaatcgaagatcacgtagcgcacaccgtccttgagatcctgccacagatccagcggaggtctgacaaattgcttcctttgcagagacttttcaccttgcggagactgttcaccttccatactactagtatctaactctttctctctcccatacacactctatgatactgttttcactcccaactagtgtactgcgttgttctttaagttcgatagcgaaatttctttagcttgtttacagcacccagcaaccgcacacagaatgtgacggcaaatgcattttacatggaaggctatctacaaaacagcaataaagagtcatgtaagattgggaaatctctaatgtgacattccatacttgttgcaacaattttgggatgcttctgcgtcgtacgaccctgtatttaccttctctagctcatcgcttcccagggtccacgttaatttttcaattttttcttgcgtgtcgaagattcaggtctcgagaaatttgtcaaaaatttttcactagatattaagaactatatacatcgaataagatgccagcacagaagagataggcaatcagtttagatactacagacactatccaatagtgcaaagcaaaagcagcatagaaaaaagagaatcccgtttccagctttttctctttttcccattcgtttttcctgatctttttttctgcatcgtggcacctagaacaagaggtaccttccatccttcgcttaatatttgatacgacttttttgatttccattattattatttgttactattattatttatcatttgggtttcggttttttgtaataattttcttttttttttttggctctatttcactaagacatcgtatatatgccaggccagataatcagcattccgtttttgtcgcagaacgaggacatggataaatacttgttggagtaccgcagtttgaagctccttcatcagtccagtaattccttccagtctcacaatgcgccctcccaccagtcgaactaccacccccattacaatcacatgaaatacaacaacactggtagctattactattacaacaacaacaataacagcagtgtaaacccacataaccaagctggtctacaatccattaacagatctattccatcggccccgtacggggcttacaaccagaacagagctaatgacgtaccatatatgaatacccaaaagaaacaccacagatttagcgctaacaataatttgaaccagcaaaaatacaagcaatatccccagtatacgtccaatccaatggttactgcacatctgaagcaaacgtaccctcaactgtactacaatagcaacgtcaatgctcacaacaacaacaacaacagcaacaacaacaacaacaacaacaacaacagcaacaacaacaacaatctttacaaccagacgcagttctccacgaggtacttcaactcgaactcctctccctcgttgacttcttccacttctaactcatcctctccatacaaccaaagcaccttcgaatacattttgccgtcaacttcggcagcttccacaaatttatcgtcgtcatcatcaaacaactctatgcacaccaacccaaccactgcaacatcgacatccgccgatttaatcaatgatttacccgtgggccccacgtccagttcgcttatctcggatctacattctccaccaactgtatctttcctaccagcaagccaaaccctgctcatgtcctccaccacatctagctctattggcaccaacataaacccaccgcaacattcaccatccccatcgcaaagggaggatttttcgacggcaccagtgaacatgtcttcgtccgcatcactcttgatgaatgattcttctttaggatgggggtctaaccacatgaacgtatcttcatcctctcaaccagcatcatcaagaccctttggcatttggaatactgacatgagcgtttggagttgagatgtttacgtatatttttatgtatattattatcattagtattactattattgttattatttatgcacggttcctatttacacgcggcgtttatattttaccattgaatatttaagatctctttgaattttttctcgaattcgtttgcctttatacgtccctggcttcgtctcattccttgtccaattaggaattttaaagaggacttctttttaccagtaaccaggttccgtataaaagtgtcatctgtgtgctgtgcaatgacatcattacagagatccatcaattcttgagggtcgacctgattaatcgcatgcaattcaaatttctcgattagttttgaaaaatctggaatagacaaatcttggcagttactctgctcgaaattttccaatatgtgaaacagtaacattttaccactagttgcggatataacctcttcatgcaataacttcaaaaactgggcgaaaaccggaggagccaaaatttcttttgctttggccaatggaatttgtagcttgttcaaatctcccaagaattcatggattatccaattcgtaggtaatttcgcgttactacgttcaccagcaagcttggaaaattcacggaaggtgtctaagtagtacgatctcaacgcctcatgattgtacatatcgttttggttactattataagtcagaatcttggcgtccttcaatgataattgatagggtttcttcataagaattctcattatatcgtccggtaattggggcatcaaccctctcacaccactgataacgtctggtgcgaggttgatatacggcaattctggatcaggcatgtacctgtaatcgatcgtggtttctttgcttctcaacttcaccgttgatgagcctgtccagccccttgtttctggctccatcagtgagctagtgtcacccacagaaatcaactcaacttgccgctgatattcgtacttgattgcattgatgatggaactagtattgggtaaattcttcaactcaacgcgtgcatattcattaattgagaggttaacgtccactcgcatggcgcccgtttccaggtccccagaggaaatgtgcaaatgacgtaccaaattctgatattttttaataaacgctctaacctgtttaatatcactgaaatctggtttagttaccaattcgataagcgggacgttcgacctatttaaatcaaccaaagtaataacgtctttatctgtctctgtatagtgtgacttccccgtgtcctgctctatctgcaactgtaagataccgatttccttggctgattcatcgatatcatccaattccttcgacagattgatcttcccaccccgagcaaacggcctgtagtgctgcgtcagttgatagccttgaggttgatctccataaaaataatgcttcctatcaaactgagatatgctattcacttgagaacccagtgccaaggatagtttcatggcaaacaagattgcttccagattcaaaaccggctgcgttcccggtagagctatgtcataataactagtatgatggtttggtgcatccactagagatgtggcgctattcgttgattgtgaaaaaagcttgtttttggtgttcaattgcgtatgaatctccaatccacacttcaatgcatattccggcctgaagggtgcaccgtgactatgtatggctttggttctggccaaagaataaaaacgtgcaagccgcaacatatctagttcctactctggtctttttggacaggaatgctaacaataacactattactaggtggtacgactaagtacatcacgtcaagcttattactactataactactattatcataacaaaagggaaaactaaaccctatctaaacaagggttatttaaatttttaacaagggcatacaacaaaaaaataataaacctaaaatcagaaagttaatctttcagggcttttgaaagtggaattaacgtctctagtaaacgaggattgtttccaatgagattctaagacccaaatatcctcttctttactttgaaatgtttgcaatggaccatgattatggatgtgttctttgtgacacgctttcaatgtactctatatcgtgttgcacgaaggattgttactttatttgtaaaaaaaaaaacaatttttcgagatgggacattaatattgtagaattctgaacatattagtgaacagttctttcggagaattactggaacctaggatctgacaagcgaacaaaaaagcagagtgcgtttattacttctctttctagcggttgttcatgtttcaaagttttttccacaacaatgggcccgctgctgccggtgaaacgttttcagatagcagatcgtaccctttaacgaatcatcaagaagtacccaggaatggactgaatgagttggcctcatctgcaaccaaggcgcaacaacaacctacacacatattaaactcatatccaattaccgggtccaacccactcatgagggcaagcgcaatgggggcgacctctggcagcatcaatcctaatatgtccaacatgaatgagcacattcgtgtttccgggatggggacttctaagcccctggacttagcgggaaagtacattgaccatctacaacataaagatagtaacactcccgtactcgacgaacgatcttattataacagcggggtagattataacttcagcagagaaaaaaacggcttaggagcgtttactccatttgaaaagcaagatgtgttcaacattccggacgagattttgcatgaattttccacttcacagacaaaaactgatatgggtattttcccggagttaaatcgatgttggataactattgataataaactgatactctggaatattaacaatgacaatgagtatcaggtggtagatgatatgaagcataccattcaaaaagtcgccttggtaagacctaagccaaacacctttgtgcctgccgtgaagcatctacttttgataagcacgacaatggagcttttcatgtttgctatttccttagacaaagccaccaacgaactcagtgtattcaatacacatctatcagtccctgtacaaggcattgatgtaatagacattgtgtctcatgaaagatcgggtagaattttcttcgcaggccaagccagtggcctgaatatctgggagttgcactactcaggttccgatgactggttcaatagtaaatgtagtaaggtctgtctgacaaagtctgccctattaagtcttctacctactaacatgttatcgcagattccaggtgttgattttattcaggctttgttcgaagataattctaacggtaatggcggattttctcaagagaccatcacgcaactaactattgaccaacaaagaggaatcatctattcattatcctccaaatccaccattagagcatacgtaataacagaaaaatcactggaaggacccatgtcaattgagcctgcctacatcagtaggatcataggtaccacgacggcaagggcagcaccgattttgggccccaaatacctaaaaattgtcaagataagctctgttgcaccagaagaaaacaacaatttgtttttagttgctttaacagtaggtggtgtgcgtttgtactttaatggttccatgggcagatttaacatcgaagctttgaggttagaatcgatcaagttcccccctagttctgtaactcctgaagtcatccaacaagaattactacatcaacaacaggaacaggcgaagagaagctttcctttcttttcaaatctaatgtcttccgaaccagtcctcttaaaattccaaaagaaatcatctgtattactagagactacaaaagcaagtacaattatttccccaggcatatttttttccgctgtgatcaagtcatctcagcaaactcatcaacaagaaaaaaaagagaactcatctgttactggaacgaccgctaccgcagggtctaaaactgtcaaacaacagccagttactttacaacataagcttttcgttagtgttccagattatggtatcttgaaaacacacggtaagtacgttgaaaatgccacgtttttggaaactgcgggcccagttcaacaaattattcccttatcggggttgtttaatgcaacgacaaagccacaaggatttgctaacgaatttgcgacacagtacacatcagaaactttaagggtagcagttttgacgagcacttctatcgaaatttataaatatcgtactcctgatgaaatttttgaggatctaatcgataatccgctgccattcgtcttaaattatggtgccgcggaagcttgttccactgcattgtttgttacttgcaaatcaaataaatctgaaaaattaagatctaatgccctgacttttttaactatgggtattcctggcgttgttgacatcaaacctgtctacaaccgttattctgtatctacagtatcctctttattgtcaaagcccactttatcaaccgcaacaactaatctccaacaatcaataactggctttagtaaaccctcccctgcaaacaaggaagattttgacttagatgacgtaatattatcccccagattttacggtattgcattattgattaccagactacttcgagatatttgggggagacatgtcttcatgacttttacagataatagggtgacatcccatgctttcatttcttcttctgatccaatcactccatctattaataacctaaaaagtgatgaaatttcacaaaataggaacataatatcaaaggtttctatttccaaggattgtatcgagtactatctatcttcaattaacattttaaatgaatttttcatcacttatggtgattcaatttcccaaatatcagctccctacgtattagcgaacaattctaacggcagggttattgataaaacagaagaagttgcaaaccaagcggaaagtatagcgattaatgcgatgatcaaaatggtacagtccataaaggaaggtctatcattcttgaacgttttatacgaggaaagcgaagtcgaaggattcgacaaccaataccttggtttcaaggatataatcagttttgtaagcttggacgtccaaaaagatttagtcaaactagattttaaagatttatttgctccaaatgacaaaacaaaatcattaattagagaaattttattatccatcatcaataggaatatcaccaaaggtgcgtcgatagagtataccgcaacagctttacaagaacgctgtggatcattctgctctgcaagtgatatattaggatttagagccattgaacatcttagaagggctaaagaaattggcttgcgtaactatgattctctaaactatcacctgaaaaatgctactgctttacttgaacaaattgtggatgatctttctatcgagaaattgaaagaagctgtatcaatgatgctgagtgtaaattattacccaaaatctattgaattcttattgaatattgccaactctatggacaaaggcaaactagcttgtcaatatgtggcaaatggatttttagaaaatgatgataggaaacaatattacgacaaacgtatcttagtttatgacctagtttttgatactttaataaaagtagacgaacttgccgaaaaaaaacagtcatcaaaaactcaaaaccaaatttcgatatcgaatgacgatgaagtgaaactgagacaaaaaagttatgaagccgccctaaaatataacgatagattattccactatcatatgtatgattggcttgtgtctcagaacagagaggaaaaactattagatattgaaactccattcatactcccttatttaatggaaaaggcaggtagttcattgaagatatctaatatactctgggtctattattcaagaagatctaaatttttcgaatctgctgaaattctttaccgtttagctacatcgaattttgacatcacattgtttgaaagaattgagtttctttcacgcgccaatggtttttgcaacagtgtgtcaccattaagccagaaacaaagaattgtacaattagctagtaggatccaagatgcatgtgaagttgctggtattcaaggtgatatattgtcgctcgtgtatacagacgcaagaatagattcagccattaaagatgagctgatcaaaactctagatggtaaaatattgagcacaagtgagctgtttaatgattttgctgtacccttaagttaccatgaaattgccctattcattttcaagatagcagattttagggaccatgaagtaattatggccaagtgggatgagctattccaatctttgaggatggaatttaataataccggaaagaaagaagattcaatgaacttcatcaacttactgtctaatgtactgattaaaattggtaaaaatgttcaggattctgaattcattttccccattttcgaactctttcccattgtctgtaattttttctacgaaacactacctaaggaacatattgtatcagggtcgatagtttctatattcataacagcgggtgtttctttcaacaaaatgtactatattttaaaagaactaatcgagacatcagattccgataattccgtatttaataaagaaatgacctggttaattcacgaatggtacaaatcggacaggaaatttagggacattatttcctacaacgatatcattcacttgaaggaatacaaaattgataatgatccaattgaaaagtacgttaagaacagcggcaataatttggggatttgtttctacaaagaataaaaattcatgttcgacatatagatagcagggtaatgtacgtgtatattttaatgtaataaagaggccttactagacggtaaagttaagaatatcgagtgaacttttccttaagataaaggtaaatatagtcgagtatttatttattattcttttccactatacagtatttaaaattctgtaagaaattgattctacatacataagacaaacgaacaggtcagagagaatcagatttttggttagcaagaatacattttggagaagaaagacattaactccaccttactgtatcatcttatttgctttttcactccttcctaatattttttttattttattttgaatttcttcctatttctgatgcattgaacagatcgtaatctgtaagtaaataccataacgtgctcacatttgtctccaaatactggtgaaatcttggctccgttgtgtacaaaacttcttaatgaatatatatatatttttcccttattttatctttttttttcgaattttttatgtaaacattcttatactggaacaatagatggctaatgagtccctataatttcgattttagatgttaacgcttcatttcttttcatataaaagactacctgccaaatgtattttctcctgagtaagtgacatacaaaaacccgtccttatccttgtgttcttgatatatggcagacatcaacgccgcagtaggtggcaaagtatcattgacaaaaatgaagatggccttctcagggggtagcataattctctttcttataacataaacaaattgccctacggtaaggtcagcaggaactagatatttacgcttatcaatctctggaatatctgacttttcagctttttcgcaaatcacaggtatcctattcttgaacctgtcagcaatcctctccgactccgccttccttttttcaaatggatattcagacttaaatgtagacttcatgtctctagtaattatttttattatgattttctcaactttacaattattagattctcttatcaatcccctcctcaacctttaatggttcccctttttgtatttccataattataccaaatatttttgccgccgccgaaaataaccggcctccgggtgatgatatatcatgtgctatgatttcacgggtattatacaacattatcggtggagacagttagcattacatgactctaacttaaacgtaaacttacacatatacatctatatcacttcgagtagagaaaaatttgtacgtatttatatgagttgttttcataatttgaacacttttaatttgaaaatggtgtcattaatagattgttcttcatcaccaattgggtctgtctttgagccgtcatatttggcaatgtcggatctacaggtcttgcttaacatatcaaaatgttctttgacaatggcttcaaagtcgatagtatctttaactaattcgtactccactaaaacatcgtcggtggcttccaaaccacacttctttctcaatttttggattctgttgaccagctctcttgcgagaccttcactctttagttcagagtaaatatttgtatccatgatgattaacacgtcttggtcggttctggtttcttgtccagcttggacagcagattctggcaagcctctaatagcattcaaatctcctttaaccagttcaataccggcaacctccaactttccgctttccaaatattcccgtacttgctcagaagtgactgatggtagggcatctttaaccttctttgcgtcttttttcaacttcttacccaatacaggccaatcagcaactgctttatactcaacaccatattttgcctcatcggaggtgataacaacatcacgaacatttaattcctcgataatgtagtttttcaaggcttctacatccttcaagtatgattcatcactgtgaaggatgaccaaagtcttcaatggagtttttaaggaaatagttttcttttcacgaatgtttctacccaaatcgataacggattgcattctagaaactgcagtttcgatggcctcgtcaaagtattctttcttgaccactgggtaagataagaaatggactgatcttccgtccttaccgtattttgctaagacagcttctgggatgtattccttcagtctcaaataaatgctttctgacaaaaatggggtgaatggagccatggcacggacaaatgtgaataaggcatcgaataaagaatttaatgctttcaaacagtcctcaacaccgttttcacccttcaaacgacgacgattaaatctaatataccagtttgtcaattcatcaatgaaattcaaaagttttggaacgacagtgtataatttgtactgacccatttcttcgtgaatgaattgtactagagattgcatagaagctaaaatccatctgtccatgacattatcacttttcacagaatcatcatattggaagtcgatgttagacatctttttcaacaaggcaatttgaccgtccaaaaatttaaaggagttccaccatggtagtaagacctttgaaacaacctccttaacaccctcttctttgaatttcaaactttcagcttttaaaacaggtgagtttatcaagtacaatcttaatgcatccgcaccatatttgttcagaacaatggatggatcagggtaatttttcaaggatttagacatctttctaccatcggcagctaagacaataccagagacgatgacgttcttgtatggaacagagccaaatagatgggtacctaagacagctaacgtgtagaaccaacctcttgtttgatccaaaccttcagagatgaaattagctggaactctttcgtcaaatttttctgtgttttcaaatggataatgttgagaagcataaggcatagaaccagattcaaaccaacaatcaaaaacttcttcaattctctttaagtcacccttaccttgcttggatggaattgtcaatttgtcaatgacatcacgatgcaagtcagtgatgttacgcacaccggtcaattcttccaattctttgatagaaccaacacagacgacctcctcaaaatcgtctgaaacccataaaggaattggagtaccccaatatctatttctggaaacgttccagtcacgggcattggcgatccagttggcgaacctcttttccttgatggtgttaggaacccagtgagatttcatcacagaatccaacatttgagggacaatgtttttaacacgaacgaaccaagctggaacagaacggtataacaatggggtatcggatctccaacagaatggataggaatggcgaatttgggatgccaataacaaatttccagtattagttaagtacttaataatcaacttatcagcgtccttgacataaacaccctcaaaatcaggaacgtctttcgtgaatctaccaaggtcatcaatggcgttaggtaacactgaatcttcggatatgacgccgttcttcaaacaagcagcattatcctcttcaccgaaagcgggagcgttatgaacaataccagtaccggaatcactagtaacataatcatctgaaataactctaaaagctgtttcatggaactgttcagcgaaatatgggaacaatggttcatacttcaaaccaaccaaatcagaacctttaattttttccacaatcttatatttttcattcttaggcttcttatacaaggttttaatcaaagattctaataagatgaaataacgatctctggtttcgtcgtaaatctttacatattcgaaatcagcgttaacacataacgacaaattggaaggtaaagtccatggagtcgtagtccatgcgaccaattgagttttttcctggccaataacattgaaaccaatggtcacagctgggtcgttaacatctttatagttttgctgagcttcaaagttactcaagggagtggttaggccagtagaataaggcataactttgaatccacggtaaacttgacctttttcatgaagttgcttgaaagcccaccatgtggactccataaaggatggatacatagtcttgtaatcgttgtcgaaatcaatccaacgacccaaacgaccaatagtttttctccaatcactggcataagtcataacaatggatctacactcattgttgtagttttcaagaccatacttgaagacgtcatctttacccgtgatacctaatttcttgtcaatgatatgttcaattggaacaccgtgtgtatcccaaccgaatcttctttccacgtggtggcctgtcatggtagcgtatcttggaacaatatccttaatagtggaagcaagaatatgaccgtaatgaggagtaccggtggcaaatggaggcccatcgaagaaggaaaactccggtttgtcttttgttaattctaatgaagtatgaaaggcatctatttcatcccaaagagatagaactttttcttcctcctttggaaatgagaagtgtgcgttactctcggacatatttccttggttttttgaagcttttggctaaaggttgtaggaagtcgagtaacatcactctagtttaaagcgcaaaatgatatttttcatgcttaagagtcatcattgtttcgagatttcttgcgtgctgcggaaacaaaaaaaaaaaaaatttttcgtcatcatggatagattacccgccatcgtataaaaggttaaacataaaaagtagctaaatagaacactatagaagaataatcaatcaacctcttccactgttggacctgtatcttctccacctcccgtagcacccgagttgggcatggatccggggaatccaccggattcccccgctccaggacctgcgccggcaccagcaccgtaaaatttcgtcattattggattggcaatgccttccaactccttttgtctatccttatattcgtccgtagaggctgcctgcgatgcatctaaccagtcaatggtttcctgagacgctgtttctaatctctttgcatcatcttcacctactttctctttgaaacttgcttcgtttatggtattcttcaaagtaaatgcatacgattcaagctgattcttagcctgaactcgttctgcctccctttcatcgtcagccctatatttttcagcttcagaaaccatcctatcaatatcatccttcgagagcctacctttatcgttagtgatcgtgattttgttactcttaccagtacccttttccaaagcagacacattaagaataccattagcgtcgatatcaaaggtaacatcaatttgaggcacacctctgggagcaggcggaatgccacttaattcgaatttaccaagtaagttattatcctttgttcttgttctttcaccttcaaagacttgaattaaaacaccaggttgattatctgcataggtagagaaggtttccgatttctttgttggaatcgttgagtttctaggaattagcttagtcattatgccgcctgcagtttcaattcctagggacaatggcgcaacatccaataatagtaaatcttgtgtctttgttgattgatcgccggttaaaatggcagcttgaacggctgcaccataagcaacagcctcatccgggttgatagaacgattaggctctttgccattgaagaagtcagaaactaatttctgaatctttgggattctggtagatccaccgactaacacaatctcatcaatttgggacttgtccagcttcgaatctttaagaaccttttctactggttccaatgtggatctgaataaatcagcacatagctcttcaaaccttgcccttgttaacgaagtgtagaaatccataccttcaaataaagaatcgatctcgatcgaggtttgagatgaggaagaaagcgctctcttagctctttctgccgcagttctcaatcttcttaacgatctttgattattagagatgtcctttttcgttttccttttgaattcagtggctaaatggttcaccaacctattatcaaaatcttcaccacctaaatgagtgtctcctgcggtagccttaacctcaaaaacaccctcatcaattgaaagtaaagagacgtcaaaagtaccaccacccaaatcaaaaatcaggacattgtgctcagccctgcctttcttatccaagccataagcaattgctgctgcagtgggttcattgataatacgtaaaacgttcatccctgcaatagttcctgcatccttagtggcttgtctttgagaatcattgaaatatgcaggaacagttacaacagcatcattgaccgtagttcccaaatagttctcagcagtttccttcattttgcttaaaaccatggaagaaatttcctcaggcgtaaatgttttcgtttcacccttatattctacttgcactacaggtttaccatctctggatataactttgaaagggaagtgcttggcatctgtcgtcacttcaggatcatcaaatttacgaccaattaaccgctttgcatcaaaaactgtattatgaggattgattgcagcttgatttttggcggcgtcaccaattaatctttcggtgtctgtgaaagccacatacgatggagtggtcctattaccttgatcatttgcaattatctctaccctatcattggaaaaatgagcaacacacgagtaagttgttcccaaatcaataccaactgctctagacatttttctttgtagcgtttagtacctattctatccgtttagtgacaaacattgacatacaagaatgtttatgctaccaatttcagtcactttatatacccttccattcgtttccaattgtgcaatatgatacatcccttaaccatcttctggtcacccttgtggctgcttctgtaatattctataactttccacagcgatccctaattaagggcacccataacctccataggcatcaagtcaaatacgtttgatgatagcgccgcacgatgatcgttatggcctttggtaatagagaccgccaacaatggtagggttgtgctcatcatcctcgtcatccctttcttcatcactgataccgtaaataagagcgtcgtcttcattgtctttaccaagcaattctggatatttgttttccattatcttttctgtgttgtgtagggagtttttttgaaatgacgaatacagacaaatattccaaactcgttcattcaacaagatgtctgagtattgttcaggcaatgtctttatctgataatataagatttcgtctaatttatcgagcatatgtttaggcaccgtagcgcttgaacatatcagttcgatcatagcatgccattgcaaactcgacccgtagttaccaaaaaacatggcatttaagaacgcaaactgcaactccccaaaataattacttgaatttttaaaaattccttgtagcattacagtgttcaagtagtaagacttgtctaaaaaatcctccatttcatggccaggccttatggcttctctagatttgaagtttattactgtatagtttaaagaatgtgcaggatcatcttcattcttggcttccattttagaacctgctttttgcaagctggattttagcagctcattttcttgaactgtggtcatcgaagaatctacgtaagagaactggttttcatctttccttactatctttcggattttatccatctgcacaaactcggtaagattgtaccaggtatcatcttcgtcaattttcggataagaaaccatcatctgccgttccttgaagttgtgaacaatattctcgaattttgcgccatccctttcttccatcattttgtaaaggccatctttaggatcatactgaatgtaaaagtttcccattctacagtcaaaccagtagccatacctcatgctggaattatctgcatgctgaaaatgaatgacatgaacgtgtccaatggggatgtccttgattccgtgaaatggctgattctccttgacattaaaggaatactgatcgatccctatagttacctcaatcggagcagatgtaaatggtacagtattcattgcaggcttccgatattttattttttagccccatgtcccagcgataaggaggatctttggtgtccattcatctcattaaaccctaaaccattgaaatattcgtgttcgtgcgtcgcgattttttccgctttcaagatgtgtcctttcttcatctcttggttcttataaaagggcgccgcaaacccctcctaattactttttccttttcacatcccatgggttttatcttataccaaatgtttaccattctgaatcgtatagccaacaagtaaccacagctgcaattgtgaaaaaaattgataggtgtggtcacccaactgtttttttctctttttctttttttttttttgaaatggctagacggtgcttttgctggtaaaagaaaaactcttgtttcaatttaacatgatgaaaaaatatattaacacagacctgtactgaacttttcgaagttttgcagataacaatattgctttttttctctgactttaactaatcgttcttatttctgtatatactatgaccttgcaaaccttgaaatgcaaaattcgtattctctgctaaattgaaaaatttagagcatgaagtgtgttttccagcagacaccgcctgtgaaaaagatggtaaaatgatatgataattaaacacacataataatagcatatatgatatataagactatatgaagagatgaggagaagagaagaaaaaattggtagtattttcatttcatctatttcttagcagtcaatcttcttaggtagaaagctaattcttcaccttccaagatgtaaccatcacatctaccggattgacctggtctggaagagatacaagcgtataatctaccggcgctgaattgagattcaacggaagattcgatcttggcagaagcagctctagcagcccactttctttcagcgttcttgctcttggcaacagtttcttcttccttgacgttcttcttcttacccaaggtttgaccgtagtgagcttcgaaccattgtctgaatggagtagcatcaatttggacaatggcagccttggtcaaagtgttagttctaaccaattcattgttggatggatggtaaacaacaccagcaattctggtcttcttggagataccttcagaagcccaagaaaagttaccggtttcaattcttagagctctgtatttcttgttaccacctctagttctaacagagtgaattctcttagcaccgatcttggtgttggctggttgacggcctaattcgaactttctcttctttctgaattgagcacgcttggcaccggtagcggatcttttgtgacgagaatcacgagaaatacccattttgtaactgtaatagaaaatttaatgacgcttgttagtaaaataaagaacgtacaaaagttgcggaatttttttcttatcttgaaatatgctttggtttcttttcatctcttcttgtgaaaaactcggcgtttcataagaggcttgatttttggggtacacaaaggattcagtttagtgcactgctcctgtcacaatttatatcatcccttttagttaagtttactttttccactatctattccattcaaagagaggtcctgtagcattcaaaataatatgtagttccattactcatatgaccatagcacatactttttgtcctggtgtgtttataacgtcttcttgtgagtaccaaaaagcaaatggcaagtgtaatttcctataactttaagataggcctgtaaataacgtatatgaaacagttccatcccgtaacaccatgaacactgcgtaagagaaagccctcaagctttcccagcgatgctcgtgtgtaggaccgaacatggaggggggaactaggcccagcacgggtttggcgaggccgctctgctcgcagctcaggattctaaaaggttattccgctgagaaaatcagaaaataggaacttctcacgcaataattttaaagttgatgaaaaaggaaaatttgtaaaagtgtaagggtgttaaagagggtgtatggatgtaaagtcacaaaagttagagcagatgaaaaagaaatgggtggagacaaatccgaaaaaggacctatattatcgctataaagagcttctcatcgcttttttttttcaaagacacatacataccacgactgtaagcacatcatttgtacaatacattaccagctgaaatgtcaacatatgacgaaatcgaaatcgaagatatgacgtttgagcctgaaaatcaaatgttcacctatccttgtccctgtggagataggtttcaaatatatctggatgacatgtttgagggcgaaaaagttgctgtttgtcccagctgctcactgatgatcgatgtagttttcgataaagaagacttggctgagtactacgaagaggcaggcatccacccccctgagcctattgccgctgctgcctaaagatgagaggctagatcgagaatacaaatagaaataaagaaagagctatatgacttagcaacgcaagcagaaaagaaggtttgcttcttcgctggactccggttggaattactattcaaaattccaagtgcactgatggaaaacgttttgctcaggttgagctcttttactgcatataaggatactgggtaggtgtatatgattattttatacatgatacgtaggctaaaatgatttggacccattaaatcatcttgtcgcatctcttttctttttcctccatgctcagatttcaataatatcatctcaaatggctgtgacaaatttcaccggaaaggcgagggatttttctgttgacattatcaaattagctttttgtcaaaataatgaaaaataaagaaaatatataaaagtacatattataatcaaagctagctcaggtatattcccaccttgtcgagcattccggaagctacaaatacgacattgcataccaagaggcaaacgttgaacaatggctaaagatattttgaagaaccaggaccctaaattgcaagcgatgatcgttgaacactcggcgcctgctcccaaagagatacctatggacgctcctgttttgaaaagagtcgctagacctttaagacatgtaaagttcattccaattaaatcgctgatattccatactaaaacagggcccatggatttttcttatgaaaagaagatcaagacgcctattcctaagaacaaaattgtagttcgagtaagtaatgtgggtttgaaccctgtagatatgaaaatcaggaacggctacacatcgtcgatttacggtgagatcggcttggggagagagtacagtggtgttatcactgaggtaggcgagaacctaaactacgcctggcacgtgggtgatgaagtatacggtatatactaccaccctcatttggccgtgggatgtttgcaaagttcaatcttagtagatccaaaggtggacccaatccttttgagaccagaatcggttagcgccgaagaagctgcaggctccttattctgcctggccaccggctataatattctgaataaattatccaagaacaagtatttgaagcaagattcaaacgttttgattaatggtggaacttcgtcagtggggatgtttgtcatacaattattgaagcgtcattacaagttacagaaaaaactagtgattgtaacgtctgcaaatgggccccaagttttacaggagaaatttcctgatctggctgatgaaatgattttcatcgattacttaacgtgtaggggtaaatctagtaaaccactaagaaaaatgctcgaagaaaagaaaatttctcagtatgatccggtcgaggataaggaaactatacttaactataatgaggggaagttcgatgttgtactcgattttgtcggtggttacgatattttgagtcattctagttcattgattcacggcggtggtgcgtacgtaaccactgtaggtgattacgttgccaattataaagaagacattttcgattcatgggataacccaagtgccaatgcaagaaaaatgttcgggtctattatctggtcatataactacacacattactattttgatccgaatgcaaagacggcttccgccaataatgattggattgagcaatgtggcgactttttgaagaacggtactgtaaaatgtgtcgtcgacaaagtttatgactggaaagaccataaagaagcattttcttatatggccactcaacgtgcccaaggaaagttaatcatgaacgtcgaaaaattctagatacccacttacatttacaatatgttttatttttaaacttaatgaacttcataatttaatgcttaatattttccccctcccaccttctcctggcgttctctgtacgtacataaccatttattttaatatataatcaaatattgtaacaattgaagcagatgagtctcgctccttagttaagcacgtgccgatgatatcaattggatttgttagcaaatcagccttgctgctcgattctctgctttttttttacttctcggtcattgaaaaatcctgacgaaaatatttcaaggtcctatatggtcatcgaccttgagcatgtggtagactacataatgcacatagactctcagcttcaactccacaaggcttctccagcaaaaatgaattcagagtctcgagaagatatggctataaatagtatcaaattgctagcgggaaactcccatcctgatttggctgaacaaatatcgaaaaagttaggtattccactttccaaagttggtgtgtaccagtattctaataaagaaacctctgtcaccataggtgagagccttcgcgacgaagatgtgtatattatccaaactggaataggtgaacaagaaattaatgatttcttgatggaattattaattttaattcatgcttgccaaattgcatctgcaagaaagatcactactgtaatacccaattttccatatgcaagacaagacaagaaagataaatcccgggcgcccattaccgcaaagttggttgccaatttattgcaaactgctggtgctgatcatgtcatcacaatggatctccatgcctcccaaattcaagggtttttccatatcccggttgacaacctatatgcagaaccaagtgttttaaattatattagagcccggaaaacagatttcgacaatgctattttggtgtcgcctgatgcaggtggtgctaagagagtagctgctttggctgacaagttagatttaaattttgctttgattcacaaagagaggcaaaaagctaacgaggtttcaaaaatggtgcttgttggtgatgttaccaataaatcatgtttattagttgatgatatggcggatacttgtggtacgttggtaaaagcttgtgatacgttgatggagcatggtgccaaagaagttatagctattgttacacacggtattttctccggttcagcaagagaaaagctaagaaatagtagattgtctagaattgtttgcacaaataccgttccggtagatttggatttacctattgctgaccagatcgatattagtcccacgttcgctgaagctataagaagactacacaatggtgaatccgtgtcatatttgttcacccatgctccagtataggacaattttttattcttagattcctgattgcttgcatgcctaaatacttcataattgtattagtttaaaagaaaaccttttactgagacaaaactataaatttaagaaaaaggttccggagccggtttaaaaaaagaagattaaagatattatatttatgtaagaattaaattaatactgtcagagaaaaaatagttttaaaggagacggtgaacctttaccttcccttgatatgcaaatatttttcagcttttcctaaaactaaacattctcgacttttttttagaagactttatgggtgtgttagaaacaaagctgtcgtctatagcagtatccaaatcgtctgctataggcagctcttcctttttcttttgaccactattgcaagttcttagccaatcatcgtacttgattagattgtctatattatcatcttgttcttttgccatattttcacgatcattcttttcaacagcgtttgaatacatcgctttataaaacaaaacatatgctgttgccatatttggagattcacctgtgaattctaacactgtttcctctttaactgcctctaccgtttcgtcatcaaataacaaccagccaaacttttcatgtttacatagggaaacataatggccgtgttgtggcccaccgcccatatgaacgacaatcccagccaattcatacttttgacaaaccttagaatttattgaagagcaaacatttagcgtcagaggatagtgaatgttattaaaaagcttaatattacagttttgtttctcagaatacttgaatcttttcaagtgtaatgttaaagtatcaggcaattgcttcaaaccaactaatctctctgcctcctgtaaaccgcaacattcgtcacaataaaacttgtttgagccatttagcatttctcgctggtgataacttttcaaaatttcctgtatatctgtttcctcatctccctgaacttctatggggaaatccaaaaatggctcatccctagatgtaatgttatcgcacgtcagacattttatttgattcgttaaagtgccttgaaacaagtcactgatgaaatttttactcttactcggttcgctatcgctgttgatatcactggctgctatttttttattctcacgttctatatattcactcaactcgtttaataagaaattgaaaaattcgtgagcatcctgatgcatagtagtattaaataatacattttctcttttgagaacatcaacaaaagagctaggcgatacaacaccagttaaatacgtattctcagttatgcattcaaagatatctctcaaactggaatacaaagtagccttatctgagccgtttaagctatggtcaatattgagcactggcccacgaataagtgcggatttctttctatgttctggggatatttgagaagaggaactagatcttctagtatcttttttatcaagtggagtggataagctgctattactttctcctttcaagtccaggttattactattactgctacctcttgaaggattttcataattgagaactctgccaacaattattttacgcggaacatccggaggtctatctgtgacgttctcgaaactcaatctgctcggagcaccaggctcattaggtgtttcgactatcaatggaggtgcgtcttgaggacgagaagagggttttccagtggttaatatagcaggacttccttcctttttattattgtcttgtacatgtttcgcgctaaaacttttaaaaaatttactcttcttctctgaaggcccagctgtatttgaatttacagaatttacaggggtaggctttccatcatcaacagattgaggtttagggttaggcaaatgtccattggtaccagcaatgcttttctcaaaacttgcttcggtaaatattcttggtttcttacctctcatttctttctttcttgggtgatcagattctcttgatttttttggaaattgcaatatattttcacgtaatgaggacagattatagagacattgaagaactgagttacagtaacatgtattgccaaaattttcgtatccaaaaactttgttggagccgtctccatagggcattgagtcggacaccttcatagctaatatgggtgcctcgggcccttgcgtgataatgcctccgtatgcgtttatagcctttgcgtttgaaatataaaatatcccatcctggctgtaattactgccttgattgcacgtttcagaagaatagtctagtccggaagaaatctgcaaattattgtcttcattcaaaaaagtttccttggtatccaaattagagacaaacaatgagctagagggattatcggatgattcgctataacagagttcatcatttatatcgtggtttacaggcttaaagtcaaccttttctacttcttctgtaatggtatcattaacagcctttttcttcttcccagacttacttatagttagccatcttctgatcatgattgcgcccttcttgcgtgggtttagtatgttaatgaaagtactggatccttactaaagccgaatttggccccttcaacaaataaagcttgatgagttgaacagtcaaagggtaagatctggtataggcaataataatattatccaaatggaaaaaaaaaaaatgaacaggtgaaaaaaaatcaatttgaaaaccaaagaaaaactctattgattcctttgctgttgtcgaccttctttcacacaatagttcaattacgttctttgggttctttatctttatagttatcttgcctcatctctatgttcaacactttcggatcgatgtatttttcagccttccgctaaaattgacgaccgtctccaaacgaatagggataaagaagcaaggactgagcgttggagaaaaaaaaaaagttaccggaatgggaatagatagatacctataagaagcgttatcgttactcatgaattttggtaaatgcacacggataaatgcatgatatataaaatattaataagaataaaataaataggtagtgaataaatattctactttggtgtggtcatcattttacaaaggagggaggtcgtgataacaaactgataaataatccttaagttgatccattcttgaatattgttacattggaaataatccgaaaaagaatatgtataaataaaaggactcgaagtcctatgtagccgtctttgcaaattttctttaataaattagcagaaaacaagggtaataatatttcttagaatattagaagaatataggcgttaaaaaccttgttccatgttcatatcgaaccaaccaaaaaagtcatcattactggagttgccttcaatccagcctgcactttgttgctgaaaaaaatccgttagtttgtttccaggagtcttcacgttgttttcattatcgatggtttggaagttagaagaagttacagtgttagtgcccgtagaaaatcgttggttcgttttgttgctattgatatcattacttttggaaaacaagctcagaggtggatatgccgtgcttttagaggagccggggtcggaaacgacggaatgcaaatctgtcatattatttgacttcgaagcaatcggtgtacgtgaatgggacatactactttgtgatcttccaatcgcgttggcgttgctgaattgattattataattcatggtgacattttgtaaattactgtgctcccttggaatagggtggtctattcccaatgtaacattattagataagttgccaacggggtggttccttaaccctggaacggacgcaggaaaatgattaacgggagtgcttactgatcttttcatggagagatcaggaattacactaggtccgttactataatagtctaccttagtactttgtggattgttattcgaagcggggacagaagccactggataaattgaattagagggaattgatatgtcattagacgcatccaataacgtcctattattattataatcgttactattcgaggtattagcgaataaactttgaaattttacgctgcctgtttccccgagcatggaaagaggtatcccgttaatctccattatagaaccgtcagaatctccgttatttgtcttggctagcttttctgcctgctttaaggcattcttagtaggaactaaagtggtaacagtggttccacttggtgttgtttttgttacagtttcaaagtcatctctggagatatggttatatagtggcaatggatatagttttctgtccgttatgccacccgtagacgaagtgccattgtagataccatttgaggaaaattttcttttcttagcggctttctctaaggcttgcttgttatattcgggatccatttcccttcttctcgcctcgtgaacacaccaaaccaaatcatagaatagagaccctgttaaatgtgatctcatcctagaaataataccgtcttcttccacaaaaacttctggatgcatgatcagtacgaagttcagtttttctaacatacttgcagttctcgaaatatcattctcaacactagtggcccacgcagttaactgatttctataaagtctatggatagtgaccacggattgccttgctgaatcaaaatatttgtcaggaagtaaaggagtcaactgcaatttaaagagaatcagtgcagaaaatgtagcagcttgtctaatataaataggcagttcaattaattggtgtgtttctaaaagattattcaatagagtgacaattttagtagctgttagataggcctctgtgacatatggaatttgatcggtaggaggtgtttcgggtaggaatgcaaaacaacagacagttaatttaacataaagaaaataaatgttgacagtatcgtcactctggaaatttaaagtttttgctaataaatctaactcttttcccaagatggacagtgtctcagcacgatactttggttccaataaaccatcaggactggaagtggaagaaccaatgatatgagacaattttgcttggaaattcgccaggctgagcaatcttctaaaactgcccggtagtttgtatttactttcaacgtgcggctcgtctttcttgttccttttatcattgttgttattgtcaatactgtcattgttatcttcttctgattcttcgtcaccacaggataaggctttttctaataaatagtctgtctgtgaagttggtggcaaaccaaggatactcgcccaacaaagttcggcaaaaaatattcccagccaagtcctagttctccacttttctgcatttggcattgatgtttgagttcttgtgaattcagaaatgaattcacctctgtgcaaacctaattgataagacagtgactttgctaatcctacaaaacggtaagaacaatcatctaggactttttggttaggcaaaggccaaatgcacaatattaacaaagcttgcgaaatatgtgtggatctaggtgttcttatccagcaggtctctatggcaagttgcttgatcaaagagcttagcttgcaatacatcgtcggttcaggatcagacagacatgccgtcaacatcacggtccagaaaagcaactgagattgggagtataattcggtggcgttattggaatacataataggaaaatacggcagatacctagtcacgaaaatatggtgtaatctattcgctttttcaatggaaatactaatatcgcccagtacaaactcatctacatttgcatgcggcgaaggcaataatggcatagtcgtggtggtggctactaccggcgtcttcgtcctatctgcattgttatttgttgctacgtggcttgttgctgcaaatggtggttgatttgttgtcgttgtaacggtggtcgacgtagtatgaggggaatatgttttttgaattggagagaaggggccgttcggagtgttacctgcagagttgttcttataaaaagccatttgcaaagcaggaggtaaagattcttttgaattattaggcaatgctgagtcatttagcagcgggggcagcttatttggctctgttgcaaccaagcctttcgaatcttgcgctaaagaagatgcgcgcaacgtcatgtgagaagatgcttcattatttgctttaaatttattcgtattgctgccctgatttgcttgtaagagttggggttccctggacaaataagtttgaactgaaaccttagaatctcgttgagccgcggaagaagttggagaacctgaggaaggagaagaatctgggttagggataatagtacccggagttggagttggatgcagattgagcttattcaaaaggctattgcccatgggaatctgttgtaaaagatgaacgaaaacgctgtcattggccagaagagtatcgagtttagatttgatttcatccacatcttgtctcagtagttgcaactgtgagcccttcttaggcctgaattgaggattgatttcacagtggagaccaattttttcgcatctggagcaaggatgagggaaattttgactagcatcgcatttgattttgtgctgtctacaatgtgtacatgaggtaactggtctatggttgatttgatgactgtcatcatggtgagatattcgttgtttcttacttgggaactggtgctgttgcaactgttgctgctccggttgtcttttcatgtgagcagaactaaaatcttggtcttggtcagaatctcgattatccttcaccatgacgagaatgcgtatacgcagagccaatataatctgtatacgggacctttgacattaaggtttctgcagagagtttattacatgcattttcatatatatatttttaacgccattcctttacggtatgtaaagaaaaatgatccaatgagcggcccttcgtacgagatgagatataataagaatgaaagatagataaaagttttagttagagatacttcatatacctgtatatagtaaagtcgtttatttcaaagcttatttcgacttggtgaatcttaaatagggtttaatttcattaaattgaccaaatttagccttcgcctcatcattggagacagagggaggaataatgacatcgtcagctggctgccaattaattggagttactacgccctccttgtcagtcaattgcaaggcgtcgattacccttaacacttcagaagtgtttcttccgacggtggaagggtaggtaaaaatcagtctaatcttcttcttgggatcgatgacgaaaacagacctcacggtcttcagtgacccatcattgatatttttgaatccttcggcatctaccatatcatataggaatgccacgtttctaaaagtgtcaccaattattgggaaaccaacatttttaacctttgctatttccttgatgtcttgaatccatttttcgtgggactcaacatcttccactgaaagcccgatcaatttaacatttctcttgtcgaattccggcttcaatttggcgaatgcgctgacttcggtggtgcagacaggggtgaaatctgctgggtgagaaaacaagaccccccaagagtcgcccaagtagtcgtaaaaattgattttaccaaccgttgtgtcagcatcaaagttaggagcatcagagtttattcttagtcttggttgatcactttgtttgaattgtttgcacagaataggtgctgtggcaaatgttttaatcgtctgtgattgcaagtgagcctgcttaggaagggtccatgccgtcctctttaattgagcgctacaaattctactaaacatcctttgcttcctgcttctttgaaatttatctcatcctactgcgagaatctagaagcacaattttctatatctctccttctctctttatataccaatagcagcaacatccggccccttgtttctttacgtaattaaaaatctccggggctagcttttgccggggaacccatcccgaaaaaattgcaaaaaaaaaaatagccgccgaccgttggtcgctattcacggaatgatagaaaaatagccgcgctgctcgtcctgggtgaccttttgtatattgtataaagataaacatagtgctatcaggaatatctttatatacacacgcatactgaatgtggttgaagttcaaaaaatatcacaaacgttaagaagttttactggtaaacatatagacatagtggagcgcttgctcgaggtcaaatgcagacggatacgagagcgcgggagggaaaccggagaaggtcaatatgcccataattcttcttctttgaggttggcaattatatattgtatctgaattaggcaaatagaaaagagaccttaccattagcgccatcgtagagtcccatttcaccttttcttagttctttatatatgtctgcgtatggcccacatatgcgcgcacagtgcgcgccaccctctaagaacgataaacataaaataaacacataaacaatcaacgacagttcgcgcttccctcactaaatatggcgagatagttaaacaatcatggctcgttcttccttgcccaaccgccgcaccgcccagttcgaagcgaacaagaggaggaccattgcacatgctccatctccaagtctttcaaatgggatgcacactctaacgccgcccacctgtaacaatggtgctgccacttcagactccaatatacatgtatatgtaaggtgcagatcgcgtaataagcgagaaatagaggaaaaaagtagtgtagttatatctacactaggcccacaagggaaagaaatcattctgtccaacggttctcaccaatcgtattcgtcctcgaagaaaacttaccaatttgatcaggtgttcggcgcagaatctgaccaggaaacagtgtttaatgccactgcaaaaaactacattaaggaaatgttgcacgggtacaattgtacaatatttgcatacggtcaaacgggaacaggtaaaacctacactatgtctggcgatataaatattctcggtgatgtgcaatctaccgataatctattattaggagagcatgcaggtatcataccacgggttctggtcgatttgtttaaagaattgagctccttaaataaagagtactccgtaaaaatatcctttttagagttgtacaatgaaaatttgaaagatctgctctctgatagtgaggacgatgatcctgcagtcaacgatcccaagaggcagattcgtatttttgacaataacaacaataattcatccatcatggtcaaggggatgcaggaaatctttattaactctgcacacgaaggcttgaatttgctaatgcagggttcgttaaaaaggaaagtggccgctactaaatgcaacgatctttcatcaaggtctcacaccgtctttacaatcacaacaaacatagttgagcaagatagcaaagaccatggacaaaacaaaaattttgttaaaattggcaaattgaatttggtggatttggcaggcagtgaaaacatcaacagatcgggtgcggagaataaaagggctcaagaagctggcctaataaacaaatcgctgctaacactaggccgtgttatcaacgcactcgttgatcattctaaccatataccttacagagaatctaagctaacaagattgctacaagactctttaggtggtatgacgaaaacatgcattatcgcaactatatcacctgcgaaaatatccatggaagagactgcaagtacgctagaatatgcaacgagagccaaatcaattaagaatactccacaagtaaatcagtctttatcgaaggatacatgtctcaaagactacattcaagagattgaaaaattaagaaatgatttgaaaaattcaagaaacaaacaaggtatatttataactcaagatcagttggacctttacgagagcaattctatcttgattgatgagcaaaatctaaaaatacataacctgcgagaacaaattaaaaaattcaaagaaaactacctgaaccaattagatatcaataatcttttacagtctgaaaaggaaaaactaattgccataatacagaattttaatgtcgatttttctaacttttactcggaaatccaaaaaattcaccatactaatctcgaactaatgaatgaagtcatacaacagagagatttttcactagaaaattctcaaaaacagtataatacgaaccagaacatgcaattaaaaatctctcaacaagttttacagactttgaacactttacagggctctttaaataattataactctaaatgttccgaagttatcaaaggcgtcaccgaagaactaaccaggaacgtaaatacccataaggcgaaacacgattctactctcaaatcgttattaaacattactactaacttattgatgaatcagatgaacgaactggtgcgtagtatttcgacttcattggaaatatttcagagtgattctacttctcactatcgtaaagatttgaatgaaatctaccaatcacatcaacaatttctaaaaaatttacaaaacgatattaaaagctgtcttgattcgataggcagttcaattctaacttccataaacgaaatatcgcaaaattgcaccactaacttgaatagtatgaatgttttaatagaaaaccagcagtcaggatcatcgaaattaattaaagagcaagatttagaaataaaaaaactgaaaaacgatctgatcaatgagcgcaggatttctaaccaattcaaccaacagttggctgaaatgaagcgatattttcaggatcacgtttccaggacgcgtagtgaattccacgacgaacttaacaaatgtatcgataacctaaaagataaacaatctaagttggatcaagatatctggcagaagacggcctctattttcaacgaaacagatatcgtagttaataaaattcattccgactcaatagcatccctcgctcataatgctgaaaacactttgaaaacggtttctcagaacaatgaaagctttactaacgatttaatcagtctatcacgcggaatgaacatggacatatcctccaaactgagaagtttgcccatcaatgaatttttaaacaagatatcacaaaccatttgtgaaacctgtggcgatgataacacaatcgcatcaaatccagtattgacctctattaaaaaatttcaaaatataatttgttcagacattgccctaacaaatgagaagatcatgtcattaatagatgaaatacaatcacaaattgaaaccatatctaatgaaaacaatatcaatttgattgcaataaatgaaaattttaattctttgtgcaattttatattaactgattacgatgagaatattatgcaaatctcaaaaacacaagatgaggtgctttctgaacattgcgagaagctacaatcactgaaaatactgggtatggacattttcactgctcacagcatagaaaaaccccttcatgagcatacaagacctgaagcgtcagtaatcaaggctttacccttattggattatccaaaacaatttcagatttatagggatgctgaaaataagagcaaagacgacacatctaattctcgtacttgtataccaaacttgtcaactaatgaaaattttcctctttcacaattcagtccaaaaaccccagtgccagtgcctgatcaacctctaccaaaagttcttataccgaaaagcataaactcggccaagtccaatagatcaaagaccttaccaaatacagagggtactggacgagaatcgcagaacaatttgaagagaagatttaccaccgagccaatattgaagggagaagaaactgaaaataatgacatactgcaaaataaaaaacttcatcaataaggggatatagccattgtaaaatatttgtatcactatatgcattgagtgtaaactgttgcacctataaagaatgaaaacaatctagtatgtgtacttacataattacacagtcttttttttttttaccttgtttatccttcttgttcttcaagcttgtaggtttttttgactcagtttttactgcaggaaaatctttacgaatcatgtttgaactgcccatatttgataaactaacttcttgctttgctgccatcgactgctcagcaacttcccttgacattccctttgctgaggaagaacttttcctgatgcttgtatcagaacccgttttaataccatttctattcgtgtttgaattcatgttaatttgcaaaccttgtggctcacgatcacgttttggatttccagtaaagaatgtttcagattttgaagaaactcttgaatttgaccctacgttacttgtttgactgtccacagtagagaataaattcaaagtactgatacttttattttttttatgctgttttttaccaatgctggctagtccaccgtcccttgagcgtagcttattaatcgccctcttgtcctcgttccctgcagctttctcgtaccatttccatgcgtattccatgttacgatcacagcccttgccatgctcatagaagtagcccagagtgaattgggcctttggcaaaccagcattagctgcacgcaaggcccattgaaaagcctcattttcatctttttcaaaagcaggttctgctcccagtaagtaccatgcacataaacctaacattgccacagaatcgccttttaacgctgcctgcgtataatagtgtacagaaagtgatgtatcctgccctactgtatcattacctgtttcataaatctgtgccaacaaagttgctgaaggaacatgccctaaacttgctgcttgaatatatagttccattgcatacttttcatccggaatgacaacatctaagaacccttcatgataaatcttagccaattcgtatggtgctgcggccgtcaactcattagctcttgctgcagcccttgataaccattttaccccatttaatttagtattaacgtcggttggaagacccattctgccgtagaatgaataaagtcccaatttatacattgctgagggatgattcctgctagccgcaaactttaaaaaattgactgacttacgagaatctcttgttgttcctagtccttcttctaagcaatgcgatgctctgtaagcactttctatatgaccatgctttgcagctgcttgaaataagacaaatgcttctttattttcaatcttcccaaatgctccggatgagtagccgtccgctaataagtattgggcatctgaataaccctttatgctcagtttcttcaaataactttgcgcttctttcaaaaactgaagttttaagtcagattggctgacatttccttccttgtcactatcttgaacaagagcattggaagattcaatagtcagtgcggtttgtaacatatattgcgcatactggaataacacttcaggatctttagattttttaacgttttgtctatacatttctattgtttttagccttggaactaaggaagtattatttttaccacccaaatatcgactgatcatctgatgtgacaaatctgctacagattcattagtagccgttaattgggtatcactgctaccattcaacaggtacatgtgagacaaatctacagaacgagttcttttctttatttgctccttcgtaagagatgtactcgaatttgtctgtcttaatgctcccggtgacggagaatttgtaggagtacttcccaaagaacttaaggaagtattatttgaattattaagatgaagctgtgggggtgggactggaacgaaatcttcctcttgactattgcctatatcgtttgatagtagaggtactgacgcagctctaagatgctcattgataagcggttggtttgccgaccgcttaggaaggtctgcggtactgaagtcttcattgtccctgttttccctattctctttattatctgaaaaatcttgacctaccttcaacgaactgttttgaaactgtaggcccctgttatcaaaatttatatgctgtgattgcattaaatgcttcttatatggatgtacctgcggtgaacttgccattttttatccttttattttaactttatcaccaaaaaagacgagaacctggtagtatacaatggaaggcttattaacagcaagtctaaagtcaagtgccaacacctagtttgtctctactcttaaatcttacatcatcctcgagagggtctgcagaaagaatttttcgttctttttttagcaagtcaaaacgcgaagtgaaacgtgggaaaatataacgatgacctttcttaaaacatgcatgaagactcgtgaaagtcatatgtacatatgtcgtatagatttgcagatagttgcaacaaataattagcgattagttatggcctatacatggcagctaagtgcgatggcatgttcaaatgtattatattaaatcaaatgaacttaaaatgcgatgtttgggtgcaaaatatctatagatgatagagacggttcattgatcttacggatcaactttgagatcagtaaggctgactagatggtacaattttgtgcagtcaatggactattaagggatcgcaaagaggtatgtgcgccagtttaaacgaggtaaaaaagaatgacacctatggggtctcacaaaagggctacaatgacaatttcagtgaaagtgagggcgtccttcatggtagtaagtcgatgcccactagcatgaaaaatatgctacagtctcccacgatggtcaacatgtgtgatattttacaaaacaaggaagctgctaatgacgaaaaacctgtgatacctactacggataccgccactgcggggactggtactgaagatattagctccactcaatccgaggaaactgatcagaatagtcatcttattgcctcagagatcttggaaggcactttcaaagatgtatcttacaaggaatatgcaaatttcttgggaaacgataacaataatcaagtcttgactgagtttgtaaagttattgagtcctttgccgtcgtcactattagaaacgcttttcaatttatcgaaaagtatatatttcattgcagaagcgcaaaatatcgaccggatactagagtgcttgagcatagaatggatagcttgccacccgaacacacattggaagtcaggctataagtcatgtcatatagtcttattttccctgttgatccttaattcggatttgcacaacaactttcaagttgaccataaaaagattaagttttccatggttgcatttatcaacaatacactgagggcactaagagaggaaaatgaatacgaagaattgaaaatatactcccgcgaacatttgatcatcgaagaactttccgaatactataaaacgttaaatgaaacgcctttaccgttatgcacagaatctagaacatcaataaatatatcagataaccaatcttccttgaaaaggttctctactctaggatcacgggaatttagtacatcaaatttacgtagtgttaactctaattctactacactatattcaagagatggtcaagtatctgtacgagaaatgagcgcaaaatcaaataaaaactttcacaataatcaccccatggatgcactctaccttaaagagtcttttgatgacggtttaattaccgaaaacggctccagttggttcatggacgatttaattcttataagcaagaaatctttaccacgtaaatattctaaaagagacaaagatcaagtggcggcaccaaaaatgacctctaagagaaacaaatcgttcttcggatggctaaaaccatctaaaacgactacacttattgagcacacatctagaaggacttctttatcgtatttgaataaggattctgaatgggagagggtgaaaatacaggtcaaggagggcagaatttttattttcaaaattaaaccagatgttaaggatatcatccaatcaagtgaaacagacagtgctaccatcgactatttcaaagatatcagtagctcttattttgcttactcactgcttgaagctgaagcacatgtcgtgcaagataatataattataggtagtggagcaatgaaatcaaatgtgtgtaacaaaaacaccaagaggaaaagtggcaactttaccgttagttttccagagaatatcaacggaccaaagcttgttctggagttccagacgagaagtgttgaagaagcccacaagtttatggactgtatcaacttctgggcaggtaggatttctccagttcctttaacacaattcgaagccgtatctaacgcagaatatggatggagtgacaagatcttgacagagcacgcttccctcaatcttaaaaatattgttgtaagtgaatggaagccactattggggctagagctactatacgaagatgcgaaagatgtagagatggtcgaactaaaagaaaggctaaaggaattgatgaacttcaccagacagcttggtatatggatagataaacataacgaaataaaggataagctggtcgaaatttggagctttgacgataactattttgaagcagtcatgaataattggaattcgagatatttgtatatgaataatcaatataagaaacgactgagctacttgaaagctttgcaaaaagccatgggttctgttcagttctaagtatatttaaagatataaatataaagactgcgctgaagaaatataaacttgaaaactgtactctgccttttatttacaagggatattgagatgatttgtgtgaatgaagtagcgacagaaaaaaagcttttatttcgagttcgcatcattgtcactttcctgctttttcttggcgtactgtctatctaagatagtctttaatatagcgtcctcgccatattcttcttcctcaattttcttccatctcttttctacatcagctctctttattctactttcaatgacagcacgtttcttgttattcaaacttgcctccttgagacacttgttcaaagcatccttttcgttgttacaaaggccaaatattctcttgtaatattccttttgatggcatttatcgagtgcattgatgaagtccaaacaggctaaaatgaagaaggggagaatacaatgttagtaagtcggagcacagaaaaaggcaaatatatgaagtaaaatctggatacttacaatgaaaacgttcagcttctaactgtggatgcatgttgtagtacttgtcttatcttgcttttgttcaactgcacttgtaaatcagtgaatgttattggacgcgcagcgattttttaataggtctttctctattaatgtaatatgcgaattgaaacataatgtaaacacaagaagaaaattcgaaataaaggactggccaacaataatgttagtgagcagaaacgacaagcccaaaatcagtagtgaggaagtcacacattttatagacgactataaaaagaggaggaaaactcagatgacacgattcttcggaatcactatttttacacttataacatgtagaattgccatgaagaaaatgataactgcaaaaggtatgcataggcaataacttcggcctcatactcaaagaacacgtttactaacataacttatttacatagtgccattgaacacttttcaagcaaactacgccagccggacgcagacaataacacacacacaaaagagtcttgcaggttctcttttagcggcaacgggcatgacactaggtatatttggtatgggcatcacagggacatgttggagctgggatgtttcatcatttcaggaactaaagcaacgtctggaaaggcgtgccaacaacgaatttgtagtgacaaacatgcctctggataaaagaagccagcaagtagtggacagcttagttaagacacacaattcatctctttgtaaatagtgttataccatagtagtagtttcaataatatattccactacttatatgtgttacccgcattagaactcttattggtggcgaaaatcgatggcaataaagaacggaaggggtttaatagttgtatgcttaacatatttcgatttaaatatataagaaacgtcggtagcacaacaattaactcattatttaggtatggcggaaatacctgatgaaaccatccagcagttcatggcattgaccaatgtgtcgcataacatagccgttcaatatctctctgaatttggagatttaaatgaagcactaaattcctattatgcttctcaaacggatgaccaaaaggatagaagagaggaagcacattggaacagacagcaggagaaggccctcaagcaagaagccttctccaccaactcttcgaataaagccataaatacggagcacgttggtgggttatgtccaaaaccaggatcctcacaaggtagcaacgagtacttgaaaaggaaaggttctacctctcctgaaccaaccaagggtagtagccgctctggaagtggtaacaactccaggtttatgagcttttcggatatggtaagaggtcaagctgatgatgacgatgaagatcaaccgagaaatacttttgctggtggtgaaacatccggcttagaggttacagatccttcagatcctaattcattactgaaggatttgctggaaaaagcgagaaggggtggtcaaatgggcgctgaaaacggattccgtgatgacgaagaccatgaaatgggtgccaataggtttactggaagaggttttagattagggtcaaccatcgacgcagcagatgaagtcgtagaagacaacacttcacaatcacaacgtagaccagaaaaagtcacaagagaaattacattttggaaggaaggttttcaagtggccgatggtccgctttatcgctatgatgatcctgcgaacagtttctatttgagcgagttaaatcaagggagggctccattaaagctcttagatgtgcaatttggacaagaagttgaagttaatgtatataaaaaattagatgagtcttataaagctccgacgagaaaactgggcggtttttcaggccagggccaaagactaggatctcctatcccgggtgaatcgtcacctgcggaggttccaaagaatgagacacccgctgctcaggaacaacccatgccggacaatgagccaaaacaaggcgacacctccatccaaattagatacgcaaatggcaaaagagaagttttgcactgcaattccacagatacagtaaagtttttgtatgagcatgtgacatcaaatgcgaacactgacccatcgaggaatttcaccttgaattatgcctttcctatcaaaccaataagcaacgatgagacaacattgaaggacgctgatctgctgaactccgttgtcgtgcaaagatgggcatgagcataaatatacaaaaacagaaacgggaaaagacttcaacttaatatataaatgcacgtatatctatacccgtagtatatatcatttgtacctcaatacaatttcaaatcacctgttatttgatccaatactgcttttggagcaggtcctaaacccaatacggtggcacttcccgcagcaatctgtgttctaccagcatcatgaataactgctgcattcaccccaagtgatatagccttcgcatacaactcgtccattgtaaacttatctggacatttcaacgttattttagcctgtccagcatttagccatctttgtgtcataattgggttgtatgaagcacgcgcggggtttgtagcaatatgtctaaaacatgacaatgctgcgtgacagcattgtgccgctattttgccctttgtcatgccaagatcttgacgaatcaccaatgccatcctaacttctccaggtatatcattcaatgaagtggactcaatatcttcgtcctcatcgctctcatcttcgctttcactttcctcctcatcagtgtcattgtgtagctttccttccttcatttctttagaacgcagtaaagtagctgaggatttcttagttgatgatgcgttcgacgtacccaactggtaacccacggcaaaggagattgcggtgaaagtagcccataaagctatggtgtaattcgaagaaactgtcatcttttccattaaaaaggacgttatcatgttactccgctgtcaacaagtaatatagcaagaaacaattagctcttatgcttaagagcttctagaagagtagtaataacctttaaacattattttcgtcaggcgtgatatcagcgagttgaagaaaaaacaacatgggttgtccctcaagagaataaactcaaaggagtaaaaggtgtttagagcttgttggctcgattgttgccaccggaaggcccctttctgtttttagactatattcattttactttttgaagtttctattataggcagacgaagaaggccaagaagacaaatcgaagaaagagagagataacatgggtcaaatattgtccaatccaattatcgacaaagagcatcattctggtacggactgtttgacagcgtttggactatgtgccatgcaaggctggcgtatgtccatggaagatgcccatattgttgagccgaaccttttggctgagtctgacgaggaacatctcgcattttatggtatatttgacggtcatggtggttcttctgtagcggagttttgtggctctaaaatgatatctatactgaaaaaacaggagagcttcaagagcggtatgttagagcagtgcttaatagatacctttttagctacagatgttgagttgttgaaagatgaaaaattaaaagatgaccatagtggttgtacagcaactgtgatattggtatctcaattgaaaaagctactaatttgcgccaattccggtgatagtagaacagttctatctactggtggtaatagtaaagcaatgtcatttgatcataagcccacattgttaagtgaaaaatctcgtattgtagctgctgatggttttgttgagatggaccgtgttaatggaaatttagcgttatcaagagccataggtgattttgaattcaaatctaacacaaaattgggacctcatgagcaagtcgttacatgtgttcctgatatcatttgtcacaatttgaattatgatgaggatgaatttgttattttagcatgtgatggtatttgggattgtttaacttctcaagagtgtgttgacttggttcactacggtataagtcaaggtaatatgacgttgagcgacatttcatctagaatcgtagatgtttgttgttcacccacaactgaaggctcaggaattggctgtgataatatgagtatttccattgttgctttactaaaggaaaatgaatctgagtcacaatggtttgagcgtatgagatcaaaaaattacaatatccaaacgtcttttgtccaaagaaggaaaagtatttttgatttccatgatttttcggatgatgataacgaagtgttcgcaataaccaccaaaaaattacaagaccgcttgaatcgtagtaaagataatgacgacatggaaattgatgatcttgataccgaattggacagcagtgctactccctcaaagttatcaggtgaggatagaactggccctattgacttgttttcgttggaggctctattagaagccgggattcaaataaggcagaggcccagctccgacagtgacggcaacacttcttatttccatggtgcttctttatcagatatgttggcatctttaagcaatgcggctgcaggagaaacagaacctaatgatgctgatgataacgatgataacgacggcgaagaaaacggcaagaatgaaaatgcgaagaagggttccaagattgaagaaattgaataataaatattgtcgaaccgtactttgcaacgaaagagtagtcaaactttgttatctttatttgttattcctcttctgccgatggattgttttttactggatcatctttgcggcccatattgaggagatggtgaaattcataaaaatcattacgagagaatgataaattgtaacagaatttataaatcctattcatatagatacatctgtttttccttactctgtttttattttgttggtaacctttgaatcctttttgatgaaaaaaatagaaaaaaaaaaaaaaaaaaaatgaaagcaatatcgactgtatgtatatgcgcaccataattttcctattaatagtttaagcataattagtgtacttactaaaaataatgtaactttgctctttgcaccaatagatgttactctccaaatatcttacaggtcgtcttccacgtggtatctatcaaagtagccagatccacgtccttgacttccgatacgacaattgctacttgttccatattacaaggctcattacggcccttgaccatgtaaagttcttctgcattcaacttgtcagcgagcttatttttcttaacggacttgaatgcagggtattcgaaatccctaacctcctggtatttggctaagtactggaaagatgcatgcgttcttttaatctcacaccacggagcatctgtctctaataacaacctttctgttggtatttgctttacaacagctagattttcctcggttctcaacgagcaaccgtttactcctatgaagatgttgggtgataagttcagtaatttctgcaaatctatcgcagaaccagtgaatgaatggaccactagttttctatctggatgaaatttgtaaaacccgctagacgacgatgcacctaacttttgtagctgaaaggtatccctctcatcagtgaacccggcaataaatctttccaatatttgaacaaaatcgtcacatgcgcttctcatatgcagaaacaatggatagctgctgagtttatcgttcaaacaacttattttcagttgctcttcaaaaaaaaccttttgcatctctttagaactatagtgaaatctgtcgtagtccaacccgatctcaccaattgacctgaaacttgtatcatgaggttttgcttgctgattcatcaaatcataaagctctttcagtttaccctgtgcaaaagatggattactaataactttagcatatagagactcattatatgcttcatccatggaagggttatcaatagaagcgctagccttgtccccttgactagcatccgcaaactcgttaacgcaacatgggtgaacacctattgtgtgatacagctttaacgggctaagatctttgacgctgcttaccaactcaatggcactttgagactccgctatggatgatcctgtaacaagggcatttttcacgtgcctctgagcagcacgctctaataattttacataatctgctggatggtactgcttaccattgtaaataccgtgaaacataggatctgtcagattcaatccaatatcatagtatttcagcggagaatccgtggcagttgatgtcatgctataatattgtgtcaaaattggtttccagagcctagaacaacttttgttcgaggatttcaataagatgccccacatataactataacagtactggcgcctcaaaaaaatgccttggcagcgaaagtgtccacctttagttgtccattgctaccaggacatcaccactgggcccttccagcatgctggaaagattgttcttagaagagtgctgttctaagtaacccggcgttagtaggggctaagccttctagaaggccggaaaaggctcagaaatgcctgcagtgcaaagcttttcaggaacgttactagcgcaagtcttctggctgctgtttagcaacctctttgcaggtatttcgcagcgggatttcgcaggtgtcttgcctagcgtatcaacacttagtagcagttaggttctaaagttaaactccacttccgttcttcttcgagttcctttttgagcggtttggcctatcttgtctcatcatcttgttagtgtgcgacgttatctgtgggtgagagaggctatttttggtccggtgaaaaaaaaattttttctctgctgagagctgaaatttgaaaattgagatgagatgcgatgcgatgagatgcgagaccaatgcgatgagacacttttctacttccttacacagaagtcgtgtatagtttttgtacgttgatattaataaaggcttttcatatcattttgttttcaggtaaacaaatctggcaaatctccactgcttgagtcattaaaactactcactcaagaaggcatatacacgacagtgggtagagaaaagaatatatcactgttcttattgaagttccctcgcgatgacgttgccgaaactcagtagcgtttctgtttcatcaggacatgttagtgccaactcacatggtttctcaatactaagcaaacaccctcacccaaataatcttgtccattcccactcactttctcacacaaatgcgaagagccacctgcctatcagtagcactagcactaaagagaacagcacgaacaaggaggaggcggaatcactcaaaaaaaacaacccctcttcttgggaccctagtgatgatatcaagctccgccacctgaaagagatcaagaacttgggctggaaggagattgcacatcatttcccaaatagaactcctaacgcttgtcaattcagatggaggagactgaaatcaggcaacttaaagtctaacaagaccgcagttattgacatcaataagctattcggcgtgtatgcgactggtgatgctaccccatccgcgggtactccgtctgcggaagaagccgtaaaagaggaagctgttgaggatgaagatattactgcaggttctagtgctatcgaggattctccaccggatttcaagccattagttaagcctaaatacatggacagaaaactgataactcaaagatctacatcaacattttcggaccatgagccacaacacacgaaaccaaggaaactgtttgttaagccaaggtccttctctcattctataacaaccaacacgcctaatgtaaagactgctcagcagacaaatctaagcctttataacactacttcagcaaagacaaataaagctgttaattccaatgattatgagaatattggtcttgtgcctaaaattattatcaggtctagaaggaactcctttattccttcaactcaaatccctcattcaacgacgaagactaggaaaaactcgcattccgtaatttcttctagaagatcatcttttaacatgatgcattcaagaagatcatccttcaactctcacgctcctacggagcctatttctagaagagcttccttggtagttagcccgtatatgtcacccagaaggttatctacatcgcaatccgttcattatcatccacagcaccaatactatcttaaccccatagcgtctcccaactgcaagacagaccacgcaaatgacaaaatcacgcacacgaggactttcttagatatgcaaaaattcgctaataaacacccgtggtctagagaagatgatgaagtgctacttaacaatacgaaggacaaacaaaaccatttgtcgccgctagaaatttctattgttctgcctaataatagatccgagttggaaatccaacaaagaatggattatttaaagagaaaaggacgtgtaagtggttttcatacaaatgaaggatgcaaagacgaggaggaggaggatgacattgacccactgcacaaggagaatggcattaacacgccatcgcagcaatcgcaaaattacggtatgttagaggctaaacatgataatccaaagtctagtgagctttcttctatgaccagcgcaaatgacatacgcaatgagcaagatgaacttccaggtataaattctatctttaaaaatatattttaagctaagagacgaatttagtttgttttgactattcgtttaatgagtacaaattaatcgcacccacacatgtacacacacacatatatatctttatatatacacataaaatttattcgtaggagaattctgtaatactattgactacaagggttcttattgctattaataatgttacatgtatatgcttatatccaatatatacccatcgccgcttattcttcgtcatcctctattagagttatttttcttctttttctgactctctccttccttatgtggctttctatatcgttttcatcctgctcttgtccttttctcttcccatcctcatcatcatcactgtcttcttcatatgtgtcttcctcctcatcattttcttctgatatttgctcatcctcaatgtcatcatcaagggtaaagtcttcgtcttcgtcttcatcttctttggcgttttcacctacatataattcagtatctacatcgttttctacttcatcctgctctaaacttgatattccagtatcgtttctcctagctgcatgatttccaagtggtgtttcggagtttttaatagtgaagcagagctcccaatgagtttctgtactaaattttgatcttggtatccctttgcgatcatggatgctttccagcactcttttttccgcttgatagattaatctatcattatttgtgttcttataatcacacatatactctgttaaggaggaaacagtgtcttcaaaaaaatcagtagcaggtacttccggttctatgatattgtttacatgaagcttggatgttttgtgctcactacttcttcttcttcttcttctgcgtttattatgtgctctactgttgttatagttttctatatgtgtgttattcgaaattaccggagccatagtttcatttgtaagagcttcgtccgctaatgcggtgggttctaagttcatcatcccatttataccaaatgacggccctaatataataggttcccacaatagtttgtcatatttgacgcgaggatagttttttgagctccaagttttgtaaatattttcaatcctgttccaagaatcgattttaataatatagttgaaatcatccaaactggataatgagcgtgttttatggcgatacaaaacttgaagttgttccaatccaaacacaacgtctgttggtatcattcctgttagtttagcgatatcgtttaggctaacctgctgaaaagtatcttcatttttattatttgatcgacgtctagcactgtctcttaattttaatagcacttcagcacattttatcttccaaaacgttctgtaagtcaataatcctaaatccgacaatggtttttcaggagttccaaattttgactcctttctggataataaatatgaaaattccatcaaaaactgaccatatcctttcctctggtatatgggtagagttaaaatacaacttaggttatagtcattggagttgaatttttccttggagaaatagcctacgaaatggaatttggctgcgttttgatagggatggttctctgtatcctctctctccgttagaatatagaatataaacggttcaacatcgtaatacaaagtcttagaattgataaaacattttgccaacaggcaaagattttgacaatacaagacattctcccgcccatcaatttcccaaacagacagcttaccgtcgcgataaatttcatttccggggggcttaaaagttagacactttagttggtgtctataaaaagtatatcgagaagtcatatattttaggcagaactcacatataaaaaccattttattttggttgatgtgttccggaaaaggagatgtataccaaggtttaatttcataatttcgaagaacaatgtattctatctgggaaaaccacactttatttttgattcttggtactttccctttcctttttttcctatcttcgttttcttgatcggtttcattatgattgcaaagtgatacgttaccattaatgtacgttgcagacttagagttttctaaaaatgtaagaaactttattttatcttcccaggtgggtaaagttctttttgtactgaaatctttcattttttttattgttccgccgtatggtacgtaccattgccaagaatcgttatccctgaatggcgtattatcagaagaatatgggtactccatgttttcggttgctagatcccatgtttgctttaacctgttaactcttctttgaaacccgattagaggaccggatgatgttatatttttgttaactaaaggtgctatgactgaagatttagatattagtctttcaaaattgaaaaatttgatagaatcatacttaattctaaccttcaactcctcgctgacttcaatattaggttcaataatggggaaacttactgctcccatcttattgtccctattaacgatattttgagaagaattttctgacgcaagtttggactgctgggaaatcaaccctttttttattttattaaggcctttatcagaccgaacacttcctcttattcgatgtgatatactggcatcggagttgaatagtcgtcttgtagttctatgtccatttgtatcgcttctgacaaattgagaatgtatcagatcatcgatctctaagtttttcaataatgcattttttttgggttttggcgattcgtcgtttgctgttaatgacattatctgcaaattatacggagactaattaatgaagaaggaagaagagagagggcggtatgaataacacctatgagaaaagaatagcaatgcttttccttttttaccttttatattcgttctttcttcttttgcctcttttaatatgctttgtttctgtgctattttcccgactctttatttcaaacaatgaagcccccaattaatcaagaaccaccaaaatagcatgtcagttgaacactcaacgactaaaaaaacgaataatttcttgttcaattggcctgaacgtttgactatgaaactttctgctcttctctgatcattgtaaacaaagaaatgtcaataaattattgttacccgactttctatatactacaaataccgccaatgatgcagtgagcaagatatcaattaatgcaaaaacaatatcgagtaaggtagaaacatctctgtgattaaacatcgtacatataaataccatatataaaagtatgtgggaaaagaacgttcaaaaaaaaaaagtaagtagtaggttaaaaataaaatctcaaaagagggaaaaaaaaaaaagagggataattttggcttgattacattgcgttacttaaagtagcctcatcattcattcattatcatcgtttcatcgacattaggtgacgtttctcagtaaaaattaacttcatcatgatcattaatttcatattcatattcggttatttttttttttttttatattttttttcaatggtgtttttgatggtttttattatatatatatatttttttatcttttatcttgtgtaagcacccctcattacttgtatcgtgcgatatacaaataccaaacaaactctataatcatagaataatggaagtatatattaccatagattcttcttgttttggttttgtaaatccagtccgcttaaagaacgattcaagccctgttccaagccatcatctagtccagagtgactcaaagatttatagatcaagtcggcactattcaaattgtgtgcggacaacatggactcatcgtgataagactgatatgagaaattagaatgtactgagccatttgtgtgctgtggaagcagttgggactgtgagtttgctgaagatgggccgttaaggttgtacaactgctgggaagacaatgaagcattttggtatgccactggtacccgttgttgagtttgggactgtgctggtggttgcgcttgggatagggtttggctgttgattgggatttgtgaatttggaggtgaaatttgagaatttctcagtaagggattaacggaattgatttgataatggttggcagaataaccggatggaattcttgaggatggtgttaaagtagcttgttgtcttaaaaaagattgttgttgttgcgcagctgactgaacattttgctgtgtttgtggttgaggttgttgcggttggtctgcggaattgtattgagaactatggtgtatgttcattttaggtgaggttagtgttggttgcatggagaattgtccctgtgaagaaatttttggtgttgagctggcgctattgttattaatgatgacattgttaccgttaccgttattactgttaatagtattgctgttggaagaattgttaacggcctgattgctaatactattcgctgcagctgctgcatgggcctgtaacaaacttgtataagattgtgacctattcatggagccgccagtggagtttggctgcaaaggatgagcagatgtcatttgaccttgttgttgcaaatgagattgtaaattagcatgatccagaatctttcttctgataataataaatcttggatcatatacttctactagccctaagtacgagcacaaaacattgataattctcttgtgggaagcggatatacccatgggataagccaactcgtaataatacttttctctatccttaaataacaataattgggaataaatttccaaagtgtcagggtcattgaagtccagttgttggggtgggagaggcaaagtggaagttgatggtaaaggcgcataaaatctctcagtggacatctgggcttgattattaacgtttgtttggtacaacgatgaagaagtatgttgggcagaaagtgaaggttggttcagaatgatgttaccactattgttgttattagaactgttattgttaatggtattattcattggactgttcatcatgctattagcattaatgccgttcattagagtcgagaataattgattgttagaagtattattgtttccgcttccactcattttagataaagaatccaaagaaagattagatgacgatctgtgttgttcttctaattgtcctcttttctctctcttctccctctcgattctttctctttcagcttggggaagcatttttttatattccactttcaatttcctcccgctgatttcctttccattcaaagaagttatcacttgagtagtttcttcaggagtggtgaaattcgcaaaggctagtcctctgaaaataccgttatcaaagtggtaattgaaggcataaggaaggggaagatccatttcttcaataatgtctaacaattgctcttttttaatagcaaacggaatgtttttaataacaatagcatttgggataacatcatcgtccaaagcaccattggtgggggcattattcaaatttgtagaagaaacgttttgttcggcattttttgcagagttctcaccagtttccgtttgcacaccgttttctttgtcaattgcatctctagtttcgatagattgctgatttgtttcctggtcattagtctccgtatttatattattatcctgagcatcattgatggctgcaggaggagcattctcaaaagaactggtctccatttcttattgttgttgaacacgctttccctagtctgtagcctgcctctatgagtactatatcacacttcttcttgcgctaatctccaaagacctgctggtaatctcagctgaaaggctgcctttaattgttattcttttccaggaaaaaatcgcaaagttgcagcatccgtgtttcgtgacatcattgaaggttaccctaatctattacctcggattaacttgaattaataaggacacacaggtatagggaaggtaaagttgaagtaatgataagaagtgggcagcaccgaagcagtttatctgaactaacttctgtacgactcgagaatatagtaagaacaccatcattaacctgaaagttaaaaatgtcagaccctgtagagttattgaaaagagtatgtagtagggaaatatatcaaaggaacaaaatgaaagctatgtgattccgtaatttacgaaggcaaattactaacattgaaatacgggaattgatatttcccgttgtgttaaggctgagaagaagggtgttccttcatcgggtttcatgaaattgtttagcggttctgattcatacaagtttgaggaggctgctgatctttgtgtccaagcagccaccatttaccgtctaagaaaagagttaaacttggcaggagactcgtttttgaaagctgctgactatcagaaaaaggctggtaatgaagacgaagcaggaaatacctacgtagaggcttataaatgctttaaaagcggtggaaactctgtgaacgccgtggattcattagaaaatgctattcaaatttttactcatagggggcagttccggagaggtgctaatttcaagtttgagcttggagaaattctagaaaatgatttgcatgactatgcaaaagctatagattgctatgagctcgctggtgagtggtatgcccaagaccagtcggtagcattatcgaataagtgttttatcaaatgcgcagatctaaaggctcttgacggtcaatatattgaagcaagtgatatatattcgaagttgatcaagagcagcatgggcaatagattgagccaatggagtttgaaggattacttcctaaaaaaagggctttgtcagctagctgctactgatgcagtcgctgctgcaagaactttacaagagggtcaaagtgaagatccgaattttgcggattcaagggagtcaaatttcttgaaaagtttaatcgatgctgttaatgaaggtgatagcgagcagctaagcgaacactgtaaggagtttgacaattttatgagactagataaatggaaaattaccattttgaataaaattaaggagtccatccagcaacaagaagatgatttgttatgaacggcatatacttacgcgcacatacatatatacatatatattataaatgtaacacttgttttacccgaaacggcgaagtaattgtgtaccgccgtgcaccttttcctcgagataaacatatagcgatgacttagagaacaaagtagtattagtatcatatacttccaacgttaatcaagcgcaataaacctttgttcgtgtgtttcaaagttattgcaagagcgaagttgaagccatcttttcacgagaagttagctgtggttcgagtctgtcgcacgccgtgtaatgtaaggatcttcccttagcttttctgatccggagcccttgagggatattacgcatcgcgtatcttcatacgattactgtactttgctgacttgcattcttgatattgggctatagttggcacttcgctcgtttcttttctttcgttatataacgtaacctttttttttttaacttccttatcctgccccttatcactctgaaccccatagataaacaaagacagaactctgtcctactttatctattactaaactcaacacattacagcccaatattataaatacgttcttcttcgttacaagaataggcgaggttgtacgaactgcaaactagctgcaaattaattgtaacacttaagtggagagcagagagtagcagcactgaaggaaaagggagaagcttatcttactgtagaagaaaatgggattgcgttactccatatatattgaaaatccgttatcttccccatcatcatcgtataaatcaataaacgacccgttattccactctcagcatcgatcgcaaaaaaacgtgagcttcatcacctacggttgtagacattgcaagacacatctttccagttccttccagattatttctagagattataggggtaggaccggaactgcttatttaatgaacaaagttgttaatgtcgttgaaggaaaggtcgagcaacgaagaatgttgactggcgactacttagtctgtgatattctttgtcattggtgcaagaggaacgtaggttggaaatacttgcagagcagcaatgatgatcagcagtataaggaaggaaagtttatcttagagctgaaaaacatttgtaaatgtacttgatgtcttcctttgtctgctatctagcacctctcgtcttttagtgctttttagcgtatgattctttttaagaatctggtctttcttccttctattttgattgggtatatttctattcgtgtttcattactggtctgggttaattgggttttggtttggtccagttgttttcaagtagcctttattttttcattgtggtattttatcttatcgatttatacttttttttattcaaagaaaattaaacagataatctcttatgagcctagctactttgttttttcttacagggccattgacttatgccctgaacgagtcttactttactttttttgtattttcaataatgtcgtgtttcccatgttgtaatacgcccaaagattatgtggtagagctttttttttttttggttagtgtatttaccaaactgggatgattttcaaaacttatgaagcagtttcaatacataactgtctaacgtaaaaattttataaaatggaaaaatagatgatgataactataacaattttaaagtacaacatattctacttttagaataattcacaatatacaaggacgatcctggaaaagggtaaatatgattcagcttcgaggaagaagtacaaaaagaagacgaaatggtccattacagactaagcactatccaacaaaaagttagtggcggcttctagatcccagttgcacttttccaaggcattgtgcgcttcttcttcagtaaatcccatgccacttaactcctcgacggctagagactttggagtagttgcaaccccgcggttaactattggaccttttgacaagctagcatcaacgataggatcattcttcaatggaattggttgttgtggaatgcttggggtagctactttggttggttcagctttggagttaccaaatccagcaaaaatctcgtcccactcatcgttgcttacttgagcagggtcactggttgactgttgttgtacttgtggttttgggatagttgggttagaggaactagttaacgtccctgtaaaagcgttcatttgtagttcgtcatcgagatccttatggtctatggtttcaaattgctccatcgacccagcattcgcaacattctcaaattcagattccgaatcagcaccattatcttcctccacagccgcttgttctaaccctgcgaattcatcatcaaattcgtccttaacaggcaaaatggaattggtgcttgccttttttgagttaccttcattatgtgaaggagaagtgcctggagcgggatattttatgacttgttccgtgtggatttccaaacttgatgtgggctgggcattatagggagtttgaagggtcttcactgttgctgatggaatttctctggtatcttcaaactcatcatcgtctgaagaggatgaatcgctttcgtcaatatgcaattcctgaattggtggaaactcttcatttattgtctttgcttttggttgagcagagatttttggagattcttggatagaactgaccgactcaccgtcttcatttgaattagccctttttgtggtacttccgtcttcaataacttctgtagtttcgttgctcaaaacatcagtagaagcggtagctggggtagcttcccattcaccaggaatgtgagataagtttccagtattatctctattcgcagtattattgatggtgtcacgttcttccaacgtttccggtagctcaacatcatctcttacggattgaggagcattgtttgcaacagacgatgtcaaggattgacttcttggaataccatattcattcaaatcaccatcaaacctatcacttaatgtttcagttaagtttggatttgctgtctcatttcctgactgggtgccgttgtttgtattggcattttcactatcgctttgagatcccaaagttggaacgtctctatcaaatacgtcactttcggttctttctgtcttttcttcatcgtctttaacccgattaacattcaagtttgaattctcaacagtagtttcgacaaatttggatacagtgtcttcgtgaacatttcctcttgatgtggcttctttggttgttgtatctgtattagaggcgcttttcgcaataatgtccttagcatcctcaggtaattgtcccatagctaaattcatttgtctttcggataactctctcacattgttagcgtattcgatgtttctctcctttaactcttgatcagctttttcaaaagaagcttttctctgtgatagatcgtcgaacatttcttgcaatttagaaacgtgctgatggtagagattttcttgttcttcaatttgtctgttacgttcttccaattgtttttcacggtccgttaaatcagtatccttgttggacagatcctggtatttagcttgtaattgtgcgtgttgctcctccacggtcttttggtagtcatttaactccttttgtttagttaagtaaacgcttatcttttcgccaagaccatcgatttccttctgcaagtttgctactgtgacttgattcaactctagctgttttgaattaacatctaccattgacctttcttgcttgacctgttgttgtttttcatttaattgtgactgtaaggaggctgtcatcgagttcaaattcgtaatttgttcttttaattctgcgttctttgtttgagattcttgcaaatcagtagttagttcattgagtttggactcagcggcatggtagtttgcttcggatacagccaactgttgcgctaatgtttcgttttctttgtttacttgaagtacttgtgcttccagttgttccgtttgtttaacattttggtcatgggtagaacgtaaattgttcaatttgatttgaatggaatttttcatctcagtaacacgtttcaactcctgggtcgctcttgactttttgtcattagttatacttgcctgcttggacagggagtttacttggttagataaattagccatttctgtggtagcattagataactgagcagaagcttcaccatctgcaaataaatcctggttcttgaatgcattattggaagatcttgaaaaagcggatgcgcctaaagcagcagcacccactgcggcgcctacagcagcaccagtggcagcgctagtggcagcgcctgctggcatgctaaacacagaaaagttgggaacttgtggcagtgttgttgaagctgtacgtttgactggacttgaagcatgttttggaactggcggaggctgagcgctaaaagtatcactggattcccttagttgctcttgttcctctggttcttccttgattatactttgaccgaagtttgaggtgggagtaaatttcttcaatccagaggaggagtgagttaaaggtggaggctgctgtggctgttgttgttgtaatgttgcttggccattgttattatcatatgaaaaactattatttgtgttgttttgaaccacagtttgtgctttagtgggagaaggagagctgaatgaagggttcaaagccagtaaatcattcaaagaaccgttatttgagttttgaggaagaacttgtggaactgttggttgagtattaactgctggggcagaaacttggtgtggcatatcctgtaaagaaggcttacttgctcttgaggggatggcaatttgaggtgcactttgttgttgaggaagtgggtttggcggataaagtcctaaagcgggggactgtaataattcattggggataacatccggtaattcgacaccagcattctttttttgaattaagaacatggcaatagcaaattccaatttggtgaattcagcattgttgtggatgtcagctaagtcccagatggtggctaacgtctcttggtttaatctagaggataagaagaatggaaccaacacagcagagcttagcgaaccagcatgttgcttatctaatgaatcaaaaattgcatcaaactgttgttttttttcaaaacttaaagaccaatctgaagcagcattactgaatgcaccagtagatagacgtgatatagtagagtgtcttgttagtgaagatacgccagtggagttagcactcaaaggagtagtcctgtttggttgattaacaacaacaggttctaaacgaatagaatcccacagctgagtaggcaacacggccggtggtgtgttcatactaggatgatgagacatacatagttggatcaaatacatggccattataaactcagatttgtctaagacaccggatgcgtctctatcacaaagagcccaaatttcacctaaagtttgatttggtaatcttgcctttaaaaatatatccttggctttatcaccagcaacagtttgagcaccctttgctgtcctatcaaacagttgtgaaaatttagcaatatcatttgaggataaggcaggaatatcagtgttgtttgtattgccggttgcactaccgctttgcataggggctgggttctgatttatagaaaaagaagccagttgagtaggtgtgctctcatatagggcagcggaaattggttggttgggagcattttgcaattgagcgatcattctcaaagcagccgaaaactcgttcaagttcaaaaaccctttattgtctatatcgacggtagcccacacttgcgatagtaattgccctggaagaccagaagacgcgaagagcggtctgactgcctcgccagtgaccaccccgagatcttccgtatccaattggtgaaatttctgattataaaaggcttgttcctgagaggataatggagttctaaaagtaatagatgccatggcctatatcgttcgaatcctattgaaaacacacagataaaaacaggaaaaaagatagatctagagcttcacgaatctatttattagtttcaacgcgctatattatttcgcgagaaccagtaattctctatttaaaagcactctattgcctatcacaaagtgctctgttgtgtgttgttttcaatgtgcttctgaaaaggggtttgtaatagttgaagattttgattataggagaaatctaatccccctccgaagcgccgacgggtaatgattgtgtagtttttcatttcgcgatcaaaagcatgtattttgacacagctaacaatacctattatcattttttgttggtgttctcatcgattgtcaaagcacaataaaaagctatgagctcgacgatgttggatgatgtggataataatatgatgggtatcaagtctatcagcctttatgaattacttagcgatgtggtgaaacagggcgacaagacgcgattggtgacggcgggtcccgagcaagttttgcctgatttaatccggcatatcactgaaacaataccgtttgacctatttataaaccttaagaatgaaatgaacgatgcgagaaatctcgttactagattaaattggctgggtaagtttctgaatgataattttttacaaaatcatacatttccattcacaatacttcggatatgcgaattgtgttatgatcctttcaaatattacaagatcaatgaattggagaagtttgtaaatgcgctagaaaaatgttgcatggtaactagcagttggcaggtttttgataaaacacacggtgagaagcaagaggacgataaggagaaagatattaacttcatcaagaatcaagaagatgtctcactaatgaagataccgtggatgaccgaaaacaatactagggagttggcaccctttattagagaaatcgactctataatgagtgtcaacctaggctacgatgacgaggatgaagaggaaggattttttgatggtgatgaagatagggagatggggaataagagtaagcgtaatgttttgctgaaagatgaaaatttcatggtggaagaatactatgaggatgattgcgggataaacgatgataatagcgataataaaggacaaaattgtcagagcgatgttacgaagaataatagcgatgatgaagatgacgatgacaacgacgacgattatcgtgaagatggtgcagatgaagatgatgaggatgatgatcacatgggcagcacagatgacgatgaagatgatgacgaagataggcaggcgggcgaaagtaccaaggtgcaaaattttgacaagaaaaatgaaactccaaggaagaggaagcccacagatttagataactttgaatatgacgaatcaccatcattcacaaacatggatctcacgacgccaaagaaatataaacataccgcaacgggcaggttctccataatagagtcgccatcgtcttcgctcctcaatgccatggacggcagtaatgagatctcatcgagccaggaggaggagaaagaggatgctcatgaaaaccatgagggtagaagtgaaggactgttaccaggtgacgaattagtgagtccatcgatgagctcttcacaagaggataagatggttgcgattgctggtattacctaccgtgagaatattagcagtccattaggcaagaagtccagatgatcgagagatgacttctctaccaacaacttcccatttgcataatatcattaaatatgttttaccaaaaaaaagttcatctttcttatttttaaaatcgatagttcttcaggatcttggtcacatatatatatatatatatatatacacttatataaaataagacgtttatttaatcttgttttcttacgagtttctttttttttctttttttattttctacttttgcaaggaacagtgaccttgccaataaataatgaagactacttgggttactagaatataaaatacatgtaaaaaattcatttatggtgtgagtgtgcgagcgtgcctgtatacatctagcagcttgcttatttctattttatgtgcatggaaaatatattatcacacatcttaccatctcatcatggacatgtcacttctgattctcatgtaatctaataacccttcaatttggcctgtaccagcaatagcaatatcttggtcccataatctcttaccggcccaagccttaacatctttgactgtgattgcatcaattttcttgaaagcctcacccagagacagtttggagcccttgattaggacttctgcgcctaacaagttagcgtcattgacgggattaccagattcgtataactgccctaattgtaatttcaacagcgatttggcacgttcaacttcagtatcagtgacagaaatggtcaatctgttccattgtttcaaagtgaaatggatgaggtcgtcaatcatggtaacgtttctcgtggccgtagagaacccccataaaccggaatctttgtaagaaagagagaaatgattgaaattgtcgcataattggtactcctgtatgttgtctaacaatttgataccttgtaatctagaagcgggttcgaaggcgttgtatgagccgaaaatttgggcggctaatttagcaacaaaataatttggtgaattgacaggttcaccttccacagccagcgaaatccacgcctttggcaaggtgtcgtctctcaatctaacttcggaacccaagaaagcggcctttttcttgagtacgggcttggtaccggtttgcaaacttaggtttttggattcgatggaatttactaaatcctcatgtttgatattaccggtaccaacaacaacagcatttgaattcaagaaatggttattggcaaaagattccagatcagcaacaactaaattctccaaggactccaaagtacctctagtaggcaaagataatggagtgttttggaaggcggtggagtgtaaatgttccaaaactctgttgggatggtcgttttcttcaaaatcttgaacttgcttcaagacagatttcttcgtggcctcgaagttagaagaagatagcaaattagccttttgttggatgaaagactgattcaagaagtctagtgatttatcggtagaacctggcaaagaagatacaatgtaagattggaagtctctggagatattggaagacaatgccaaaccttccttggcggcaacagcagagttttctttggatagaaagatgttcttccataaattggaaaccccgttgttataagggttttcgttggcagcaccggagccgaagacaacaccgacagaggctgtgtgagcggaaggattatgctcagtggctacaactataccgttagataattgcgttacttcggccttgggggttgctacagctgtagccaaagacctcttgaactggttagatacagtctttgaagttactgttcttagcattttttttgtttatatatcttgtgttttctttctcagtgatatggtgacgatgatgttcttctcgtattattactccacaattgtcttgatcagcaatggtagcaatttaatattaggattcgttacctatacgaacagggatgatataatattttttctgtgaaagctattgctttattatacgctgttttcctcgaataagacggggaaagagagtaggggaatatcggttagggagcgctgtaggcctttaattttcttgtttggtttttatttggtgcagctgacagcgcgggcccttgaacttctggaggacaaaaaacactgttaatttattggcatttcattggtgcagaaagcgtgctgtccgggtcacagttaaagttcatatacatgttaccctacccagtccgggttatgtaaatcgtgaaaaagaatatctggttttaaaatctctcttttctttttccccctggtgggtatgggtgaaatgctagagaggcaaaaaaaaaggttgccaagtaaagcgaagtatttgaagtatactgcaagcatcaccgaaacaggaaatcacgaagctgactcatctgtgattttccgtccccaccatagtgatgtaacatgcagtaacgcacggcgggccgaaagtcggactttaccccagatttgtagttgtatcctattggatcacgggcgacggacaagacccgaagtgcggaccggcatggtcagcttgcacggaagctttaagggtttcccttgtttcggcattagaagaggcatttcgcacgttttaccgggtcagaaacttcgaggaagctgtgacaattggaaaaaaaggcaaaactaaatgcaatgtatccggttgcccatgcattatttgtgatgttttcggatgtagttcgctgcgctccgcggcgatatatcctctagcgagaggcatatgtataaatatatatatatatatctaacaaaagcattcaagtttctttctctggtgttacgtctttgttcgactttctctgcttacagccctgtatgaccaaagaaaaaataaaaagacagctacataccagcagaaattttttatagtattacactatacatccaagttttttcacaattatttattgtttttctcacatagaaaattccgcatactgcgattataatgaactctacaaccccatcgattcaagatcaatatattttggccagcaaagtacgctccaagctggcaaaatgcgttagcgtgactactaaaaacaaagactacaacctgagagttttagtcgggcacgcaaacttgctggataagattacagaaaatgtggaaactcataatgctgcaaccaacgcccttgccggagaccctttcagtaaaggacctgaaaacttgtccatcgaacatatcgaattgtccaatgctaatgctagtaaaaatgacgtcggtaaggaggaaaatgcagaaaagacgatagaaagtgaagattactgtgatttttactctagtgacgaagatccagatgctgacactctatcttctactgacagtgaagacgatgatgattatgaagactatgattttgagtacgattactctggcggtgattataacaagaaaattgacatgtactttagttttcacaccgcacctaattatcaatatttgactcacacaaactctcattccgagcagacggatgaacttgccgaatcaacgccgcgctacaatgctcttcccgccactgcctctacgacagaggaagaacaggacactgaaacgctcgatgctgtgagtttgcatagttcagcgccaatcttccgtgtgctctctcggcgggtaaatggacaagaagatgacagcgaaaacgagagtagtagcgatgtcgacgatggttccgtaccattaacgagatttcattcttgtcctatcacagcataaattaaaatgaaggaaataacacaacttcgttttgcattatcatattcacatctgcatcctattttttttttctcattgttgttgtatcattattactaactagtgcatcaccacttgtctaaataccaaacgcaaaatatatatattcttacttcataacgttcaaaataaagtttttagtttaaaataaaataaaataaaaaaaaaaaaaaaaaaaaaaaagaaccttttgttttcgcccagtatatgggtaaattaacggttccttttattagtcattttcaactctataccatgctccaaaacggcgttcggcacaggttttttattttaccacgataactcaatatgtacaagattattgcataggcgaaaagtaaagttttaatatggtactttgcgcaataaaactacgaattcaaacgtaaaataagactacagagactaaggtaagacctgttctgctcagataagtggcgttgtccaagtatcagttctacgggaacgtaagaaaaaattttgcgtgagctctcttgagaaccaaaccttcttttttttttttacgaaatgctatttcgttgcagtgagaaggattttttgaaaacagaaatgagttaggccaggctgctcgtactcgcttaaattaggagtgcgagactgaagacctatggtaaacaagactttttttaactaatcaagcatgcgtaatgttatttttacaaaataaaggttacaatttgagattatgcagaagcatatgtctatatgtatgcaacaaatatgatgaggcctatgcagattataagtaaattatttttttttttttttggctttgacattatcatgataaggtgctacttgcgttgttaacaattgtgtttagatatatcgtatcttttcatagccagtggaaacgccgccatattcttcaaaagcttctctttcagttccgaattcttctacttcgacccactcttcgagccatttacggtcagttatcttggcatcgcctggaatacccttaattgggtaaaaatacactaaaatgcagtaactcaatgctgcaaggagataaccaacgaaatagtttaggtagtaaactttcatagcgccaataggcacagaaactcccactgaacctaaaaagcctgcaaaattaggagcaataccaaatatataagctaccaccgccctccagttcgtaccatatttattgtacatgtagtacgatcctggcttgtcggtgtagcaatggaaaatattaacgtaaccctttctgacaatgaagtaatcggctgatattacacccgcaatagcacttaagaaaactgcatatgccgctagtgccgtagtaaactttgacgatgatgataataaatcccaggggcaaatcgccaacgatattagagcacaaatataagaaccgcgtctgatattgatgaatttaggcaataatgcagtcagatcggtacctgcagggatcgagttaccagacaagttggcacccagctggtcaaacgcaaaaatgaaagatattaagaatacaccggctctgttccccgaagtatagttatccaagtacctgttcagaatgtctaggggactccaataatttactccgtacaatgtataagctgcggagacagacaatattccgattaaggaaataatggcatagcagacgggtagcgcaatcaattgcgagtaaacagatgacttgtaggtcttaccgaatctagtgaagtcaggagcgtttaggattaaagtagagaagttatccagagcactcataatagctctaatgacagaccatgctaaaaccgtcttgctgattgcgccaccattgtcatttagggaacccaatgccaaatgacctttggccttacaaagagtccaaatcaaaaaaccgaaggccgcaaatggagtgatggcggatttgagtgcaaatatatgacgcaatttgtcaggtggaaaccataggaacggtaaacatgcgacccagaagaccatgaagcacatgaactcgaagttcgtcaaattggggttctttatggtgtctttgattctagtattcaaattagtaccgaagatagcctttagcatcaactgaacacattgactaccgatataagccaaagtagaattccagacacatgccatgacgacacggttgatgacaatccagatggagaagtagataccaaatgatactcttgaggaaatggggaaagagatatggtaattgttccccactttggaacccagtatcaagaaaaatgcgacaaacgtgtatccaacccaaatacagatccaagtctgccaccagttaagccctaactgtagcccagtggctgagatttgccatgtattgacgttaaaggacccagaaatccaaaagaaaatgtactgcttccatgtccacgttcttctttttgcctccacgggccgcagatctgtgttgtacaagtacgtcgaacggagggactcctgtaaatctttaaatgtcctaattggattttcgggcttatgatcggccaaatcggtagagtcattcttaacctcaaaaaactcgacaactctttgcagccaagacaccttttcgtcatcctgagcaatggttatattgttttctgaatcggtatcttttttttcaatgacattagcatcaatcttagaagtaattttagtcgcatcacccatctcggactctttcgtgatttcttcgtaatcctccgtcggtatagtgtcgtccttcattgtttttgaagaattatcgaatccagaatcagataccggcattttctcttatatagaattaatgaatgagaggactagttaccgccttttatttccgcaatgtgctgcaaagtaaagcaaagctgtccaatactatgttttaaattttacaagaaggtcgaagcaatactactgttatataaaagataggatagcatgtcatcgagtaattgagcaagagaggaaatgaaaaacttttccgttggagaattgatcaaaaattttcaaaaatacgacatgtccctgtgttgtccaggctgacacaatagtttcagtagcgagaaccgccaagttttattgcagcatcctttaatggcaaagatggcgcgataaggacgaaaccggcaaatcccgagcatcaaccacagtgaacgccgcggagaaactcaaaggcgaaaggggagaaaaaaagaaattaatggcacataccgctttgtggcatggctcaatcacatttctttttcttctttctgatcgcccgcaggagaggcagcgccgtttgtgtcccatcgcaaggacaaactagctaggacatgagacttctaagccgttcagtcgaaagagttagggcattagtctctaaagataagtgtgggggcttggttgagtcttgatttaaaagcttggagtaggcattttacgatctattttctctcgaaataaagtaaaggtattgctgcaaaggaattgccgtaatatttaaaacttcttgcttaagtgatgtaaaggcagtgaggcgatagcaatgtttcgtagagcctgtgactagtgaagcataggcaataaattgttttttttttctgattttgtattgccgtctctgcgtcgcagagatttggtgttcgtacggagcgataattgtttttatcttttccaacttaaaggatcgaggaaactcaaagggtggcaaaaacaagcggtataatacaaggtgaactgagttggaaagagagtagccaagactattgaactataaagttaaacaaaatatggccactattgcatcagaatactcttcggaggcgtcaaatacacccattgaacatcaattcaatccttacggtgataatggtggtacaatcctgggcattgcaggtgaagatttcgcagtgttagcaggcgatacaagaaatatcaccgattactcaattaattctcgttatgaacccaaggtttttgattgtggtgataacatagtcatgtcggcgaatggatttgcagcagacggcgacgctttagtaaaaagattcaaaaatagtgtaaaatggtaccatttcgaccacaacgacaaaaaactatctataaactctgcagcaaggaacattcaacatcttctgtacgggaagaggtttttcccttactacgttcatacgatcattgcgggtcttgacgaagatggtaagggcgctgtctattcgttcgacccagttggctcctacgaaagagaacagtgtagagcaggtggtgctgcggcatcattgatcatgccatttttggacaatcaggttaatttcaaaaatcaatatgagccaggtacaaacggtaaagtcaaaaagcctttgaaatacttgtccgtggaagaagtcatcaaactggtgagagactcgttcacttctgctacagaaagacatatacaagtgggtgatgggctggaaatccttattgtcaccaaggatggtgtaaggaaagaattttatgagctaaaaagagattaatgcatacatatcatagtataaaaagaaatagaccaatatcaacatcaattttatgtattttttttttcttttggtatagcattgatatattgaaatttgtatatattgctgcgaacactatttaaaacaggttttttttttattttggcagtttgaaaccctttcctctgatgactttagtgtagtaaatgtaaaagaaatcagagtacaacagagtttgcaaaagtcccgcgaagaaggcaatcttgtccaattttttatcttccgtgctgtacctccaaatccagttaggaatatacaatgctctgtataatcccatggcaaaaatataatgaacagttagacttctagtcttcccacccttagatagcatgtacaattgaggtagaatagccacactctccaaccatacagaaaaactccatgctaattcaagaaaagtgaacttgtgatggaaaaaaacactcattagagcactcccaattagtaaatgctggatcttaaaggtatcatgcataagcatttcattatacgcaatggtgttggttcttttagacccttgtaatagcactacaatgtaagcggtagatacaatgaaaaatattttcattagagcattgtatagggatacccagtgaaaagtcaagagatccaagtatcgtgttatgaaaaccaaagcgtacaacgtttgggtcttgaaagaaataccttcaatgtaccttgtggtcttgatattatgaatcaggatcagtatactggttagatgtgataaatcacctgtcttgatggtcgggaaaaagccctttctctgttagtaagattgggttcgatctacggcgggaaaagcctcatgaaactccaaatagtaacatacctaagattctaaacggattcattgcttactgattatgcctcaacttgcgcgtatatctcactcttgaacaagtgccctcagcaaattcatctgcctcgaaatttgaacttatttttaacgtgttcaatatttagctaaaacgtcgttttcagtccgggtaccgcagataagccatcccggatctttaaaggaaaacgaggaattcagtggtgcagactacactttaatctcaattgaccaaagtgagtcctcaagtaagacgaatattatttttctttcacgactcaattgaattcctaataacacttttgtttgctgtattagcttttagctttgagagcgatgaagcaagagagaaaaataagggtagaaaaaaaaattagaaattgaggaggggaaggtattctaacctggtgaattcccagatacataagtataagaatttctcggcagagattatatacaataaagaataaggttcagttggacgattgcgatagtagcgtgaataacaatttactttaatcaatcgttaggatacttctaatgggcttttttaacaataatccggtaattgaattcttccacagaataacgagaaaacccagtaccattgcgatgtgggtgtttgctggtctgatttgttcaagtacattttatttaatgttcatgtcatcacctacaatcgacttcaactcgaagagtaagaaaaaaaatgataaataatctccctgttcagtactttggtaaaagcacgccatggaaaattatttagaacttccttatacaaaactaaatatttgagcatattctatattcatacatagatacattctttgaatttcaagactcttatttctcattttgaaagccaagattggaggaaaaatcgtaaatttttatccagtcagtaacaactgttggccagtcgaaaactctatcgaaacagcttctatatgtcagataagatagatttattaaattaaatatattcaggagaggaaagacaacatgaacgaaaaaaaaaaaacagtgtagagaagcactacaaatattttctcttccaaaaaatataatatacataaaaaaattagaaatttatctttgttaatgcagtagacttttaattctaaaattttgatttaaaagttgaatttgttttcgccggcctcaagatcgtacttaccttcaatgacatcttgaaggataccagcggaagcagcaactaaacccaaaaatggtttggatggatctaagacctttgatgtgtattctgggtgatattgagtagcaatatagtatgggtgattctttaattccaaaatctcacaacgctttccagtgtcgtccttacctacaaagatcaacccgttgttttccaattcatcaaccatctttggattgatttcgtaacggtgacggtgtctttcatggacttcggagacgtcaccgtataacttcttgatttgactccattcagtttcattttggaaaaatgttggtctcaaacctaatctcattgagccccccatggtttccttgtcaatttcaggcatgaaaacgacaacgtgatttttttcatcaatgtctggataaaattctgccgaatgactgtcttttcttcccaacacactacgtgtaaattcaatggtggcaatttgtaaacccaggcaaacccctaagaatggaatgtgattttcacgagcccatctagcagccaaaaccataccttcagtacctctaacaccaaaaccaccggggattaagataccgtctgcggtactgaccatgttccatgcttcatgaaatttagttttgttgctttcttgtgcttcaggttccaaatcagtagcttccacccatttaatgtctaacttacgacgacacttcatggatgaatgttccaatgcttttatcactgatagataagaatctttcaagttggtgtatttcccaaccaaagcaatcttcactgtttccatggattcatcgaagttacctgttgtggccttccatttagacaataattccaggcctctttgtttttcttcttctgtaagtgatatttcatctaactttaatctggcgtgtaagtaatcaatcatcttttgttccagtagcaacaatgggacgtgataagtagaattaacatcgtgaacgttaaccacctgttcaggccccacatgacaaaacatggcaatcttatcgattgttggtttatccaaagtttcactacatctacaggcgatcatatctggaactaaaccaagagacctcaaacctttgatggcagcttgagttggcttagttttttgttcaccgtggatgacaggaactagagaaacgtgtatcaaggcaaaattttcctttccaactttaaattggaattgtcttagtgcctccacaaaaggagcactttcaatgtcaccaactgtcccacccaattcaatgatacaaacatctggttccataccggtgtcatctacaggaattttggccacgcgctcaatccaatcttggatagcgttggtcaaatgagggacaatttgcacggttttgcctaaatagtcaccttttctttccttagcaataacgtgcgagtatattttaccagtagtaatgttatgatctttagtcaaagtaactccaaggtatctctcgtagttacccaagtccaaatctgtttcaccaccgtcgtcaagcacgaaacattcaccatgttccaaaggagacatagtacctgcatcaatgttcatataagggtcaattttaattgacgtaacctttaaaccgagggttttcattagcataccagttgaagatgcaagaacacctttaccgatacccgaaatgacaccacctgaaacaacaacgtacttcattttctgtctataagtttcttttgttctattgaccaattcactgagaaactgcctgaaactttttcgaccttagaatggcagaaaaatggcaaatactgtaaaatacttaacatttaactaaattttattctatgcttttcctctcgatgagatgagctgtgaaaaattttgaaaaaaaaaaaaaaaaaaaaaaaaaaaaaaatttgttatcaccaataacgagaaacctaactctaaaacttagggtcaaagaacagaaccctaggctttgtatccagttgaatcactaattacgaaagaatgctggtggaaataataatatcatattggtgctcaaataacaagaagacttctttggaagaaattattaccaattaacagtccacttgtagagcgtacatattgccgggaagttgattacctttcaccagaggtacagaggaatagaattttgcaacatgttcccctatttaacaagaatgaatttatccataaagatgggagggctaactttaaaagaaagttcccccaatgcttttttaaataacaccactattgctaggagattcaagcatgaatatgccccacgtttcaaaatcgtacagaaaaagcaaaaaggtagagtgccagttcgtacaggtggttcaataaagggatccactttgcaatttggtaagtacggattacgactgaaaagcgaaggtattaggatatccgcgcaacagctgaaggaagcagataacgcaattatgagatatgtcaggcctttaaacaatggtcatttgtggaggcgtttgtgtacaaacgttgctgtatgtatcaagggtaacgaaacaagaatgggtaaaggtaaaggtgggtttgaccactggatggtgagggtacccacagggaagatccttttcgaaataaatggtgatgatttgcatgaaaaagtcgcacgggaagccttcagaaaagcaggcaccaagttacctggggtatatgaatttgtatccttggattctctggttagagttggattacatagtttcaaaaatcctaaagacgacccagtgaagaatttttacgatgaaaatgcaaagaagccatcaaagaagtatttgaatattttaaagtctcaagaaccacagtacaaactcttcagaggacgttgaacggattgaacacaccatgtatacatgtatataactattgaaaaatatcgatattcacaatcaagtaatctagccatggctatgagtttattaattctagtatgcactgtatactctctgcggaagaataggagtttttccccggagtgagcgctgaagaaacacatgacgacgtgaaaaaacacttgtttgatccagctgaggtataaacactgagaaatatttgagggtcaaagaagcactaggaacgttacagttggaatttgctagtcaatcgagtttccaatttcgcaacctttattatagtactaatcttataagccatggatcgcaaaaaaacacttataaactcaagtgtttctaataataacagtaccatcaagggcctacagttattcattgcagatcttcgttctgcacaacaagcacaagagcaggaaaagagaatacaatctgaaattgtcaaaattaaacagcatttcgatgctgcaaagaaaaaacaaggcaatcacgacagattaggtggctatcaaagaaagaagtacgttgccaagctagcctatatatatattacttctaatacgacaaaactaaatgaaattttattcgggttggagcaaacggtagagctgttgaagtccagcatattttctgaaaaattcattggatatatgacccttgagttgctttatgaacgtagtgaagttgttgccaaagttaacgatgaggtgaattatcaactgatgaaagatctctcttcttccgatgataatttcgtaatgttggcgctgaattttgttggtgtagtaggagaacttacgaaccgtctagcgtacaacgatgatatcacaacaggagtattcaagatattaagatcaccgacctcctccatttatctcaagaaaaaatcagcattgtcatttctagcactattgaaaagtaatcattctatactgaccgaagatttacaacgtaagcaactatggatacaaaggatattaagcttattggatgatacggaaaactataggttaactttagctacgattccgttaatagaattcattgcaaaatacattgatcccagttactgtacgagactattaccacagctaacagaaattttgtacaattgtgttgttgttggtacttcaagatctagtgacaatcagtttccgttagaatatacgttcgcgaatatgccaaatccttggcttatcacaaaagttgtctctttgttgagcatattgattgcctcaccaactgagagggattctggctcattactacaaaccaacaacatagataatgaattactaaataaacttcgaaagtgtgtttccgttgccatcgaattaggaaccagacaagctcaagatcccatggaacgtatcgtccaaaacacagtattgttttcattgatcaatttcgcctctaagctagatccgtcggatgaagctatcagcaattctgtgacagccttatgttccctgctaacatctaaggaaattaatattcggtatttaacgctagattcattggtcaaattatgctcatcaagcgggaaacctgcaattgatgccgttcgttacaagaatttggatatgatttttcatcttttgaacacagaaagagattcatctattgttaggaaggttgttgacttgttatatacctttactgatgttgaaaacgttaagattattgtggacggtttactgcagtatattttatctccgaaaaatcttgctgaaccgcaaataaaatctgatattgcagttaaaatagctattttgaccgagaaatatgccacggatatcaattggtttgtaattatttcgttgcagttgctatcattaacttcaaatacaactattaacgatgatgagatctggcaacgactatgtcaaattgtagtgaacaatccatctttacatagaataacatgtgaacggttggtggactatttatgtaaaaagcaagcatctgaagctattattaaagctgcggcttttctactaggggagtactcaagtctcataacagacaggatttcaagcgcaaatttatttactttgtttgccgagaaatattttagtgcaccaaatgtggctaaggcgatgatattgactacgatgatcaagttgtacaagacctcacctgagatcggctccaacgtcatcaaatttttccaattggaattgaactctcttgatattgagttgcaaacaagatccttcgaatatctcaacattattcaactggctaaggtgaacggaaatacagatattttgcaaattttatttgaaccaatgccgccttttaacagcaaatctaatccattattgaagagattagggtcactgccggcatcagcgggtagcacaactttaataaatacaccatccgaagcatcctcctccacgcctgacttactatcaaaaagagcaaactcttccaggtcgatcatggttcccatgcccccaccatctcgtaggaacaccattgatgatgtaaattccaaaattagttcatctgaagacttttcaggaaaggactcttattattcaaggcagatcctcgctccaaattggagggaaggtttcacaagaatgatttcgcataagcagggtgtgcttttcacatcatctttgatgaaagttttctatcggataaccactcctgatgcacaacagccatacgtgtttcatatatctcttgccttcattaacctgactgagtgggaaatcacgggattatccacacagattatcccttcaaaaacgcaaggtaatcctgagtatttaattatgaatattaatacaccttctactgctactattgggccccataaaagggcagagcaaagctatgaagtttcaataagaaaacctttcgacgttgaagatagtccaattttggcaattcatttcaaatgtggcggtagtacaaacactatcaatttgaaaactgccataggcatgactacaacactaattagcagcgatgtcaatcctagcatgcatttgaatttggcacagttcatcagccgttggaagactttgagcgatgctttgggaaaagagggagaataccaaaaatctggcataaagctcaacaaggattttagaaaagttgaaacaatcagtttagaagacggacttctactattgacgcaaacagtgaagaggttgggctttgatatagtcgatcagaccagtgttcgtagtacattgtttgtctcgggtattattcatacgaaaagtgagggaaacttcggttgtttaatgaagatacaataccaggtaaatggaacagttaatgttacctgtaaaacaacgacggccggtcccctggcgaagtacattgtcgaatgtataaagaatgtgcttacgaagtaaaattttctcaaattcactataatgaaaatcatccgcattgtacatatataaacacacacacacatatatatatatatttgagattctatttattttcattttgtgttgtaatgctataaaaaaaaagatcttcgtataaaatctcagttcattcaacctactaaatgattctagcttcattttttggaggtctagcaccaaaaatgtcggtaccaattctgacttccgctgttccttgccttatagcctccctgaaatcagcactcatccccatagacaatttcaatgatgtaccaaatttagcatcaatcttcttcttccactcaaccagcgtagcaaagtctctgttttctttgctatcttcatgagagacgttccatgaaccaatagtcattaacccattcaacttaatatacttgcattcttcggataagaagaagtcgatgacttcaaatatttctgcttcattattcaagcccgatttttgatcctcatgggaggtattaatttgaacattacacaatattgggttgcaatctggttgaaatttagccctcgattcgtttaattttttggctttcttcaaggagtcgattgtttcaacagagtataaatttggcactttagccaaatctttacatttattcgtttgcaaaccgccaataaagtgccacttgatatcgtctggtagtaattttgccttttcgatcaactcttgaacatagttttccccgaactccctcacaccatggtcgtaaagaatttgtatatcgctagctggtttcaatttcgaaacaaccaataataaaattttggaggcattttcattaacatgaacattttttgcctctgcattcacaacttcccttacagattcgtattgggcaattaattgtgtctttctatcttcatcataagtaataccagtggacatattgcaatgtgatgctggaatcttagtcaaaaaggaaagagtgatgcctatcagtttttttttttattatgcatttaagagtagtctctacttatgaacattttctctggcctctgatcacgttactttattacccggatactgatcatgttatggtctttaatcaataagtaagttatagagccagtttcaaggtcgatagttcaggtgtataacaatactttttggtgctaccttgagctattccattagttaagtttgaattaaatatatcaactagcaatcaagtcaactctagcgcgcttccacacgttgtgtagataaactggctcttcaccttcaacaagcgtcaatttcccgtcttcaagatcagggcattggacagtaatttgtgcataggatcccctgttacctgttgctctaataaatcttccgggatttataacaactacgttttggacaactcttgcaaagtgttgtaattcactgggtataatcattatgtcaggcgagaacccaccaacaaactctgttagtcccagataactcacgtctaaatctgcaccagatatatgttcataaactttttcttctttgctttccatatcattggtttccttcttcgtagatacgtcttttggttttattcttgtacgaatactacctggaaatatggggtaatacctgcgctgttgtaaaatatgctcagaaacacgatctaatctatatcttgatgaggtagtaccgccttttatgacttcctttagatctttgaatgtatcaacgtttgagcaaccgaagtatatctcatttatttgaaaagatgaaggattagccatgcatttgaagttccttttaggcagctgtaaagcctttctaattaaagaagcttgtggatatgcggcgtgattagaaattgcatcttttgtggagggtatcaatacggtttggatatgtggtgatatggtttttagaataggagtaaataacttcaaaaaaagctcgtccaatgttttgggctgtgtcttgaactggggaaaatttggcaatttaccactcgctatcagaggatgggtgatatctataaatgggccaaacattatcaagacgtgaggttttacctcattatttatactatcgataaattcttgcaacaattcgagggagaagttatcatttgcaaagtatgggccacaggtcacgataaccttcaaagaagaaccttccaaatttgcttgaaactcctgcagttcctgcgatgtggacactggggagtttggataaggtagcggcaaaatagagttaacggtgaagtaatccccattagcatttttacctttgaatgccacaatttggcctaagaaaaacgaaagctcgttgacctgcgatagatctaaccttacccttcttccaacgccgcccattcttgaggtctctagggaaagcgattctggattcaaaaacttgtcgtaggtcggcgaatctggaactatccttccaacagcataaatttcggactgagattgaatagttggatcagcgaagtcgtttggagataacttatagtgattttgaataatcttagtaaacgattcaatttgatcatcgaggacatcagacgcttcctgtaagttttgcctcattgttctgaatttatactttttagcatcataaaatggttctactttgacctggttatatgatggttcttcagtcgaaagaaggcctacatttggattaccagatgatatttcaatattttcagggttcaaagaatccaaaatttcaccagcaggaacattttgcctcgatgtggtaggagtgtttgttgttggagtttggaatgtcgacgagccgggagtcttggcatccgagcttttagcgtgggacaatggagcactgtcacccacagcatcttctgccatgcctggagtaaactccaattttaaagaactatttcctttttcatttgtttctgcctcagagcctacattatatgtttgcttggaatcactgagtgaaaagggaccatgtaactttcttttttttaaagtcggagtctttggaatactaaggccaaacaagggacttgaattcaaactttttttaatcactggtttttttgtggatgtgtttaccttagaggacgatgaaatttggttagcacgcttttccatttgtaattgtaaaaattgtttaaactcatctatgttcttggaagtcagatctgtgtgagtttgacgcctttgattggagaactgctcccatttaatgtatagatcctcgacggacaatgcatgcagtttagttaaattctctaatgcagtgatgatttccggcttgtctgcatcaggcccaaaatgagtgatgacatcgatagatccgctcatttttttttttttcagtcacttgctcctgcctaaatttaccttcaagctttgttgaaccaattgacaatcaattatcttgatatttttatatgcaaatatattatgtatatgaaacaaaatgttatatgtgtctacaaagagctcatattattacagttttagaaaagagaaagaactaagaaactctggtgagacgcgtcacggtaaaaaaaaattacgcgtctaccacgctattctctattcgtttgaggcgatgaacatgatcattttaaagacattcttaggcaaacaatcgaataatcgttcggtttcttgctcagtataatctggagtagtttggaggactctcaaacaacgagctaataccacggcactggtgaagttccacgaagtattatcagtccccataatgaaatagctcattgtttggataatctctgatatattagatttcttgaattgttggcaaatggtaggagattgcagcatcttccataaggtctcaattaaaaatgtttctttcacaccagcggtgtcaggctgaatttcagtaaccaacatgcttagaattcttgttgccgaatgttttttgaaaaagtgcgataacattagactgtccctgaactcttgcgctaatttatagatttcgtttccataatcagaaaatttattaagcattaaaaggatctgttcccatacttcttcgaaacacattctcaccgaaacgccatcatcgtcggcattctcgcttagtgtatttagaaactttttccaaaccaaaagacaatgaacgagaattatggacttactggatatttttgatggaattgaaggcgtgtcatcagtagatttcaaaagcataatagcaacatccagtagttcatcaaaaccattttcattcgtcaaccaatcggtcattttttgattttgaaaacaagtaatcaagggttcgatcaggtaatttatatgtttcatagtgaacgatccactttttatcctgtttattgcctttgacatgtgattgaaatagacatcaaaatccatcaaagtgttgccattagaatcaaccattaaaagatgactaatttcatatacagtcaaggaatcccttgggaaattatccatgataagcaaatgcatcttctctgattttttgttattaactagtttcatctttttggagtttatgtcttgttcagttagtgctacgtctctttctctctttactgtgatcctttgcttttgacccatattctcgtccccgtttattttgattggtgacattgtttccaaatcaggcttttcattctcattcccatttccaataagtttttctggctcatttattatctttggaggatctgtactgaattttactgttggttcattatcgtccttcaatttcctttcggtattttcaccactgttttgaaaaatttcacttaaattcaaatcagatttttgagaattttccatatctatatcatcttcctcctttgctgggtttggctggtccagttgataaacacttactattttcgtcatttctgaaagctttttatctttgtcattatcatcatgaataactacgctgtctgtgcttgatgttctttttccaacgttattcttcaactctagtgttttatcagtttccaagtttttgaagggattaatcattgtcatttccatgcatttcttaacatcattttcgtctacagcatcgtcggattcctcatccccttcagattttttattgtcgatgggagtgaagcttacagaactttctctagaaatgatgtcttctaccttaaagttggcatccttcttttcaagttcatgacagattttcatcttggtagatacaatgtcaaaatcagctagcaatttattaaaacgattattatcgaatttataaatttcaaaaattagattgaaataacatgtgtagtcaaactctttaccgtagatttgaaagagtatcattgatattttaggcatgagatcgttcgttcctgacctcagagtgttatcatgttttatgttcaagttacggaaaatctctaaaagtaacttgaaattataattgaaaaaagtggttttgtatttcatatagtatagtttgaaatcattcggacaattattggcattcaagaaattgaataaatccgcgatagttataatcaagttagtaagctcgtagggcttttcaggattcattctattctttaagatttccgcgtaatcaaaactattaatagaatatagctcaatgaggtaatttaagggaactccatttgtaaacttctctatactcaaaaatggcttgaaatcatttggtgactttatcataatttggcgtagctttttcataatcatgggaaattcaaattttggggctgatgatgactgttgcgatgtcaacagtaactccttttgtaaatactgtaaagcatctttgatctgagctggaaacgaagcatcattgaattttttgtaaagggtttcatattcaccaagtttattactgccttttaatgagattggagaagatgacatcgaaacatcatttttatccatatatttctttatcaacgggttagagtaactatttgataactcatcagtcaagtcgatttggtttgacggaaagtcatcaaaatttgtgtaattttcagatacttttgtggcggcagtagaagaaggaggggcactaacttttcttttagtaacattattattatctttggtgttgctgtttgaaacagagttcatactgtcatgatgccttgcccttttttcattttctttacttgaatattcactagtagaccttaagtttgttttcagcttatttgatagtttactggctatgacacttccaccagctgtgactgcaggagcgttgagtagggaggtggaggaagattgagtcggttgggcataacttggatagttccttttctgctccagtaaactggtttttcttgaagaattattcgaagagtgagagtacaatcgagacgttgcagaggaggcggaggcagtagaggacaccctggaaacttgatagtttatattcaaatgagcagggattgccaattctgttgcttttttcaactgtggagaaaaggaagaactcaataatcttttggcatttgtaggataacatttgtagaaataccaaaaagttaacctcattgcctctctaacggttgtctgtgaatctgaaatgcccttttttagccattcttcgatgtatatgatgttattctccaactttgaggttggcgaagttgtatttgaattgttgagcgaaagattggagtcgttgaacttaatcaggaagctacgcagcagtattgcagagcaaaatctcggtgttacggttttctcatttattaataaaaaagataattggaatagtttattatggaaatgatttatatcaatgatcaaagtaattaaacaatgaaatgcagtttgtgaagagattttcttggtagatgataacaagttcttgaaaatgacaaatatttggtccaatattgataggggcaactgatcgtttaggatatggattagcctcttgaggaaaagtaatgcagttaatgataacgttgtcctcaacgacgaggtagctcttgaaatcaactcaatcaactgcacctcctttattacagtgacaaattcctctggattatctttgggaatgttgccggatataatgttgtctaattcaattatatttgattgccttagcttccaattttgttctgtttcctttacactttggaacggtgccaacaaattctccaagtcttgttgtaattggttcaaagactcatagttttttttcatcgctgggtctttactgctcaagttgtttgataactgcggcaatttcgcttcggctaatagtaattgaaactcgtactcttcgtcaaacaaggtcgatttatcttcttgtgaaccatgctggtcctgtgactttgctaaacttatgaatttttgcttgaatttctcaacttctaaatcgttaataaatccatctatcagatcctgtgaattttcgtcatccattttcaaatacttgtacattatatcgaaaataagctctattattacattattgttatcatcgtttgcgtgttcatttaggttgttatttaaaaggttggtgaaagacagcatgaaaaacctcagtagttgcaaatgatttgaattatttttctcgttgatctggatcaactcatcgatggtcaataatgtagattttatcctattcaggtaatctccgttttggttttcacttggtcttcgcaagaaatttgctagaatagcttggatcttcgatggattaaccaaataaatggcttcaatggctttaatggaagccagccaaaatttcttctcattaggcaactcgaaaattaagtggtttagtaattgctcaactagagtgtcattgaattgtactggagactgcatggccacacgtttgataaggtaacaaagcgaggaatgtgataggaagattaaccgcgggtacgaacggtaagcgtaatggccggagatgaacagtaacgcagcgaaataagcttggatcgacgattcgttaactagttccttttttacatgtcctttgaaccgtgtaagcagtgccattttttcctcgatgggtacagactcgtccttgaatacggtatacaaagggaaggaatcgtctggatgtgtattagtgttgctgttattattggtctcattgttgaaggacgacattatttctgaagaatacaaggtctctccaaaaaccctaataattaccgctaaatatgcctgtcaatcggatgaagggaagtttcaacctcaaatgtaaataaatagatgtttagcgttttagaataaataagtaaataatttgattttctataaagatgttaatgcgccaatacgcgccgacggggtaacgcattaaaataacatggtattttcgtttcattacaaaaaaagcactatatgtactaataattatgctacacttgtgtttatattgccagcgtcgatgttgatgacaacgcagagttcatacggttttggttttgggcttcacttgtctcagtaggttgagggtttgtatgaagtttcagaggctccgttagtaaatgacccattctttctatcttggtcctgagataaccttctatctccttggagtctatgccttcactggagtttgtccagtgtatgggtaccataggcactcgttcaacgcacttaaggtaaggcgcatgatctacctgttttatcttttccgggttatttgtcagcagcctgacattaccgatgccaagatccagcaaaatagccttacccagcgagaagtccctagcatccacgggatgtttcagcattaagttggcctgcactgtgtcagcacctaagtcttgcaggttgtaggccttgagtttctcacctaacccgatgccacgaccctcttgtcttagatacacgataacaccatggccgtttccacctttgatgttgcttgtgggttcgtggtcgcaagcgataagcctaccggccctatcgaattgttcaccacaatcacaacgggcgctccatgcgttttcaccggtgtaacattcagaatggatccgtaccagcgtgtcgttatgggcgtcccatgtagtggctttggaagctaataactcacctgtactatcatcaaactccagagctaatccgagtctatcgtcttcgtctgccacagttctgccgggatacagtttgccaatataagcgcccctgatcattctatcttgttgcgtctcgcactgtcttctacggaatagcgagcgcgaccgtatgtcttcaccaaacacaatggctagatgttccttgttgtccctgttgttactgtaaagatgtaaaaagatatccggaccctgtgtggttgggatacgagctcttgcgacacattgtactagaggcaagccgccatcgccgttcctgccatcacccgtaccactaacctcgtatttgctgctatcctgtttactgttgtcgtagttatctatggtcatcctgtaggtttgttgtagttttatgtacgccactttttgtaatgactcaattattgtccacgccagcacagcaacttctttatatatactatagcggcgctggcgctcaccccacaagagcgtccgactaatttctgacaaatcgtaaaaagaaaaagaaaaactcaaaggaaaaagaaaaagtctcaccctacacaacttgttttcaaaaacggtatagaccctactatttctgttttagccctatgctaagtctagacattaccctatcccttttaacgaaagcccttttgttttttttctgtgtgtccggccgctcagccaaacaacaaacaagactataatctggagcataagtacccgagcatatataactacttggcatacgaagtaaaagcatattgctccccactcctatcgcgcgtcccctgtacaacaaagcatcaacttatcgggtaacttagagacagcattagtatatataccagccatgtcacagttcttcgaagctgctactcccgttgcaattcccacaaacaataccaacggcggctccagtgatgccggcagcgccgccactggcggcgcccccgttgttggcaccaccgctcaacccaccatcaatcacaggcttttgctgtcattgaaagaggctgccaagatcattggcactaagggctccaccatctcacgcataagagctgcaaacgccgtcaagatcggtatttctgaaaaggtgcccggttgctctgacaggatcctgtcctgtgctgggaacgtaatcaatgtggccaatgccattggtgatattgttgacgtgcttaacaaacggaatcccgaaaatgaggacgcagctgagggcgaagcggaagagcactactacttccactttttgaaccatattttaccagctccctcaaaggacgagatcagagatctgcagcaactggaggacatcggttatgtgaggctcattgtggccaattcccatatctcatcgattatcgggaaagcaggcgccaccatcaagtccctgatcaataagcacggcgttaagatcgtggcttccaaggacttcttacctgctagcgacgagagaattatcgagatccagggtttcccaggatccatcaccaatgtacttatcgaaattagcgagatcatcttgagtgacgttgacgtcagattcagcacagaaagatcttatttccctcatctgaaaaagtcctccggtgagccaacttccccttctacctcatctaacactaggatcgaattgaagattccagaactgtatgtaggcgccattattggccgtggaatgaacagaattaagaatttgaaaactttcacaaaaaccaatattgtcgtggaaaggaaggatgacgatgataaagacgaaaattttagaaaattcataatcacaagtaaatttcctaagaatgtcaaacttgctgagtccatgcttttgaagaacctgaatactgaaattgagaaacgtgaaaactacaagagaaaattggaagctgccgaaggagatgccactgttgttactgaacgctctgattctgcttctttcttggaagagaaggaagaacctcaagagaatcatgataacaaagaggagcagtcgtagtatatacgtgtgcgtgcgcacgtcccacacagacaaaacaaactatcatcttaacgaataatgttgcatcattactagtttaaactgtatttttattaaagggaaaaaaatgattcaatatgtatatatttattcatgtatatgtattttgaattaaaaaaaaacgttttataaatactcaataaagccgttgtattttctttattactatcgaaattcttgctttaaacatttcgcgcatcgccggctagaggcacagagagggaaggggaaaataacatgaaaaaatcgtaagtttctaggcaatggtataaacaaataaacaataaacatgcaattacagctctagaacacatattatcttcatggatgaatgataaactccaagaagagcataacgaaaaagacaccacttcacaaattaatggtttcacgccgccgcatatgagtatagactttcattcaaataacaatagcaatatcatcgagactattggcgtttccaaaagattaggaaattctgtattaagtgaactggattctagagctagctcaaaatttgaatttttaaaagatcaatccgaacaacaatacaacggcgacaagaacaatgaaccaaaatcgggctcgtataatattaatgagttcttccaagcaaagcacgactctcaatttggccagatggagtcgctagacacacattatacccttttacatacgcccaagagaaagtcacaacatgcaatcccacaggatcgatcggattcgatgaaaaggtcgagaccgtcccgctcaattccatacactacaccagtggtaaacgatatcacaagaagaatacgaagattgaaattacggaactcattggttaatggtaatgacatagtggctagagcgagatctatgcaagcaaattctaacattaattcaataaagaacacaccattgtcaaagcccaagccatttatgcacaaaccaaactttctaatgcccactacgaattctttgaacaagatcaattccgctcaccgtaatacatcctcctcttcgacagcttcatcgataccaagatctaaagtacacagatcgatatcaataagagatttacacgccaaaaccaaaccggtagaacgcacgccagttgcgcaaggaacaaattcgcaattgaagaattcagtttccgtttttgatagactttacaagcaaacaacgttctctaggtcgacgtctatgaacaacttatcgtcaggaacctctgcaaaatccaaggaacacacaaatgtaaagactcggttggttaaaagtaagacaagtggttcattgtccagtaaccttaagcaaagtactgccaccggcacaaagagtgatagacctatttggcggtgattaagtaataaaaaaattgcattttataagaaacatcatgtgatgacatttaaaaagtgggaaagaatactactaatataaaactatttactggatatttagaattttttttttttcttctttatacgtaaaagttgttcaaaaaatttcatcgttttctttttttatgaatctttgattcttgttgaaaagaatttctaaaaaaataggaggataataatattatcaaaacaaatcgtgtcactcattaaacaccaaaaatccaaagaagaaaaaaaggaaaatgtgagaaagaatttagattaagaatcaagccagattagacttatttgaacttcttaccaaacaagatcatttgcagttggtcgtacattgagataacaccagcacctgcgacacctcttaagatgttagcaccacaacccttgaatagagaaccaacaccttcagcagcaacaatcttcctcaaacagtcaaaggcaccgtcgtacttaacagcttgaccggaggtcatcatcattcttcttctaacggtatccaatgggtaagaacatgtagaagcaccagtagtaacaacccaacccaacaagaatgaagccaagaatgaaccttccaaagaaccagtcaacaatagaggcttcaaagaatcgtacataccgaagtatagacctctgtagacaacaataccaacgacagaaggtaagaaacctctgtaaagaccagcaacaccatcagattttaaggtcttcttgtagacatcgatcaaaccgttgaattgacgagcaccaccctttttagaggacttggagtcagcagccaatctagttcttgcataatccaaagagtaaacaaatagtaatgacaaggcaccagcagcaccaccagatgccaagttaccggcaaaccatttggcgtaaccttcttccttcttgaaaccaaacatggccttgatcttgtccttgaaggcgaaattcaaagcttgagtggggaaataacggataacgttagcagtgttacctctccagaatgagataacaccttcctgtgtagcggttctcttgaaacagtctaagatacctgcgtattttctgtccaaagtaccttgttttaacatttcatcttggttttggatcaaaagtttaactctttcgatgggagatgcagcagttttggcgacagcggcactgacaccacccattaagaaatcaatcaaaaagttagattccttctttggagctggggctggaggtaatggggttttgacttgggcgttggaagacatggctatttgcttatatgtatgttaatgtatgattctgaagtataaaagagcacacaaaaaagaacaacgacaaatataaataatatagaggggctcctttgacttgtagatgtattgcaatgttccgtataactaacagtgaatatatacttttttgagtgggttgtcgtgaaaaattaatattaaaaactcaaatggtatttatattgtgcgacgacgtgggcccgatcgacggagacatgtccccgataatcgcacctcaccctctgagagtggggccttctcattggcccgcgctctacaccaatcagcatagcgcatttaccgcctttcgcttgttctccattggaaacagtgctcgtgcatcgtgatgttatttgttacgtatggaaaaatcgtgtctatacttctgtataatatatgtatggttatagtgaacacatatatataaatacatatataagaggaagaaaaggaaattatttcgttatcagttgggctgcttttgtcgtaagttttgttgttcttgaatgactttattaagctgttcgtcattcttaaaatcttgtcgccaattgcatatggggcagtgcaactgttttccccagaagaccggaaccaacggtataaaccaaatagtgaaaaattcctttctttttatggggccgacactataattgtgacaattcgggcaatacaggttttgatgtccgggaacggtatcgtatgaagagtcgaaactcttcataccacatacaataggtatgaatgacatggtaattttttctttttgaggttgtgtattaagttgcttatctgatttcactttacaccaatcttccttgctgacatttattcccaacttgttcttcagccgcttgttttataacgtacattattgtaaaaacggagtagaaagggaaaaagggaaagggatggacgtggctaatgcgcatcttcgtttgtgtgtatatcctttgatcttcactacataatttgttacccgacaatgcttttttttttttctcaattttcatctcttttctttttcctcatttcttatgaaaatcagtgtgactaaaatgagacttcgtattttttgtagaggcaccatacgccggctccgccgtcaccacattctcccctgccggtaaagaccggcgcacgcggaaaaggcgtacatagcgtcgggcggtaacggagtcattccatcgctgataattaccccttgcagcaaacccagagccctattacgaatctagcccatacaccgcgttagagcactcgccgttttgctccgggtcgtgccgtcgtacatgcatacgcgtcctgcaggcataccataagcccacatacaatcacctgtagaaagaaacaaagcttgtgtatgtaatcaaagcagaaatctgatgggttcgaacgacttcgttatagaaatattatctttgggtctcgtcctgcgttattcctcctgtctcctgccgctttgataaccttttcattcctccccttaacttgttatttcgtgttacgatattgggtaacttagtagcgtaaatggtaaaatgtagggactcaatctcataggtggttatgtttttcgttctcatttttcaaatctgtgacttcacagacaaaacgcgtagtgatttctttatctgaatgagccttcgaaaaaaaaaacaacgatttcttatgcagttagtcggccagttggttattgactatctgtgcgattccccttcctgcataaaaataaacacaatcttaatacgccatacgttgactccattttttgctcgtttcattatattatcttcccatgccgctcctgcgtgggattccctttattataacttttaaggtttctacccacatatatgcaatttttatcatgtttttctcttttttttttttttttttttttttctctctttgttgtgttttcgagaaaaagttcaattgtttaaaaggaattaagcaaattatatatatgcgactgttggtttccagttctaatctgtactcttttttttgaatttgcactgttatctccttttatacttgcgtgttaatcttgtattaggcaaaagcttagtcgtaatatatagagattataaaaccaaaataaagctaatgtgcgccaatatccccgaattcgactctttttacgaaaatgaaaatataaattacaacttggaatcattcgcacctttaaattgtgatgttaattcgccctttctccccattaataacaatgacatcaacgttaatgcttatggtgacgaaaatttaacgtactccaactttttactgtcttataacgataagctggctactacaactgctaaaaacaatagcattaataatagtaatagtaataataatagtaataataataaaaataataataataatcataataataataatctactcggtaatgacatcagtcagatggcctttttactcgattacccttctactctcaacgaaccgcaatttgccgtaaattgtaaagacatttacagaaaggatatatcaacgccttcgtcattagtttcgagtctgccacctgcaaagttttcgttatccctatcgaattcgccttctccgccaccaccatcgtcgtcctctttgaaacatggggaagcaataatttctaataccagcgaaagcagtgacatatttgccgatcctaattcgtttgaaaaggatactatgcccctaacgcaagaactgacgctagaaaatctaaataatcaattaaactatcccgatttcacgataaacgccatcgagcaggatcctgccccttcgtctttttcatcctcatcttcgtcttcggagtcaacggtctcttccagcaggaagaggaagccctgtcatgattcctacacacattcttcaccctcttcctcagagtctaagaaaatttccgactcgagattatccgccgaaggtttagccaaagtgcttaatttagaatcccccgaagaagctttaaaaagagaacgctttatattgggtattttccagaatgaattaaattacccgctaggttacaaaacgtggattagggatactacaaaagaatataggacaaagttaatcaatcaactgcacgaacgagtaaaggtaaagtaccccgaatacaaccagtccatactggaaacaataattagacgaggcacctactacatgatgcagagtaggttaagaagagagaggagaatgaagcttaaggaacgtaaaagaacaacctaattttattacccaaaaaaaaaaatgcattatatatttcatccatatatagaacacacttactcacataaaagacaaatatataaaagtgaaccggttttcatatcatcaccctctgttgtcctttcaactcttaaattgtctaggaagagataaagcacggtgaagaataaaaataacgtcggaattttagtatggtacataattaaaaattttacaacctagctcctatcaagttcttattaccttcattttatcagaatctggtgaaagaagtttttttcttagattgtttcatcagcttagcctttttataagtgtgatgtctaccgtctctccaaccagaggtgctgattttttttctgggagcttcttcattggattttttctcgtcgacatccatgtcaattccttgctcttctttcttttttagatcttctaatttttgctttagtaagtcttcctttagtttatcggatattctttgttcacgtgcatctactgctttttggaaaacgccacgtcttttgacagatttagcatttagatgactgctagcacgtaatgatttggccatgattcttgttctagtaagttttaacttattttatatgctgaactcttggtttgtcatcagtgtcaatatatcagaatgttttactaatacctagtacgaaaatttttcgtagagcctcatcgctctgtctctcgctatccaaaaaaaaaaaaaaaagtggaactggatgaatattgcgtataaggacagtgttttaaaacccagacatatttttcaccagtacctcttggaaaacggaaaaagtttttttgcgaatactttcaattcttgagttgtaaggctgcatccctccgtagaacaaaccagagagccgagcttagtaatgagcttacggaatgttcgtcccactgggagggagtggcaataccgtctaacctctcgcctacgttctcatcgctatgggaattgggcaggcctggtgggactggcccttctttctacacattccacatcggtagcttgttatactcctcgggagattactgtatctacatcgggatactaatagtacatttatacgctagtgctacttgatagatcttttcaccaaatcgaataaaaagtcaccaataaattagaggaaaatgtatgtttaacagtgatactaaattttgaacctttcacaagatttatctttaaatatgttatgaatgtcatcctttggagagaaatagataaggaaaaaaattgaggatacagcatccggtggtcgcatagttggtagcaacatccatagaagaacctcagataaatttcaagcttgtacgaattgccgcgtttattacaaactatagaattatcgcagcaatggtacgtgtctgttcctgcaagcgttaattcgattgatagataaagtaattcattaacctttgcgaatatgctctttactgttaggtttcaggattttaaaaatgaagcaactttactaacatcaatatgcaaataaatctgcaaaaactttttttcacagggctaacttgcgtactcaaaagagacttgccgcttctgttgtcggtgttggtaagagaaaggtttggttagacccaaacgaaacttctgaaattgcccaagccaactctagaaatgccattagaaaattggtcaagaacggaaccatcgtcaagaaggccgttactgtccactctaaatctagaactagagcccatgctcaatccaagagagaaggtcgtcacagtggttacggtaagagaaagggtactagagaagctcgtttaccatcccaagtcgtctggatcagaagattacgtgtcttgagaagattattggccaagtaccgtgacgctggtaagattgacaagcatttgtaccacgttttgtacaaggaatccaagggtaacgccttcaagcacaagagagctttggttgaacacattattcaagctaaggctgatgctcaacgtgaaaaggctttgaacgaagaagctgaagctagaagattgaagaacagagctgctcgtgacagaagagctcaaagagttgctgaaaagagagacgctttgctaaaggaagacgcttaattgattacaaataattagctaagaaattacgtaccttctcattgttctatatatgttttattttctctaaaatgtaccaaatacaataatagtttcaaaggagcagagaaagaaactaaggtgaaggagactgttcgtagaataaatgaatattgattaaaattttctgaaaaaaagagtaatgaagtcgtagtcatcgctaatgtaccgtaagtgagttctgaaaggaggcgggttcttgtttcaacgtagcttgtctagtcctttatggcatcgtgtaaaattggtatatattcagaacacccaggagtgaattgatttgctgctatagggggaaataagatgtaacgatattttttgtactgaatttctttgatgatactgccaggattgagagtttggttgccacatgtacgcttaggacactcatgactatcactcctgtgtatcgcttccatgtcgtatacccactggccgattctcaccctctgcattgtatgatattactagtattgcttgtttcaggggcaagaattttcactaatacactaccagtttatgatagcttatctacatccttttactgcaaaattattctggatttgcaaaattattctggatttgcaaaagttcggcttcactatcaaagcgaaaggtgacctttttatcgtacctttaagaaagataggcataaacaatactgtgtggcaggaaaagatttgatgaagaccaaaaacagcatcgaagtgctttgctacgatttctttttttactctccggttattttgagctatcttgtcattatatctttaaatttatatatttctttgcccagcttttaagcgttcactggaattgcccatatgttcactaaatataaaactgattattctctcctctatattgtcatctcggcagaaaagctacttttaaataagttttaaacaccagttttctgcaatgataaaaatagctactttggatagaggctgaggcctaactagttggaagaaactacttagggatcctttgtacgggaaacttttttccgctgttgtaattgtatcattgtcgttgttcatttttcaaatccaggcaatgaggaagttttgaaccaaaaaaaataaaaccgaaaacagagcaactttaattatagtacggcatataaggaaaacaaatccagaattcaataaaagaatacaatactttcgaacacatatctcacgctgataacaccctagcaagtatgcttttcttctcctttttcaagactttagttgaccaagaagtggtcgtagaggtatgttcataatgatttacatcggaattccctttgatacaagaaaactaacgggtatcgtacatcaatttttgaaaaaagtcaagtactaacgtttgtttacccctgtttattgtgtttccactcagttaaaaaacgacattgaaataaaaggtacactacaatcagttgaccaatttttgaatctgaaactagacaacatatcatgcacagatgaaaaaaaatatccacacttgggttccgtaaggaatatttttataagaggttcaacagtcaggtacgtttacttgaataagaacatggtagatacgaatttgctacaagacgctaccagaagggaggtaatgactgaaagaaaataagaattatgcagtctatcctcatggcattttttctcattagttttttacacgagtatcattttaggatattgagattatatgtatatgtatatatgtaggccataagatgattcaacggtttgtattaattatccggttccgagcgttaggagaaataacttggtgtgatatctgtcaagtggtcatccaaaatttttttggccagagcgtaagctacgtagactgatgaggaattctttttttttgccccattttatcccaagaaattcattatgaggttttgttttgttttactaaatgcgcttgatggaaaagcgaatgtcatgaaatgcagatcaacactccaataaaaaagtaaatgtttttaaagaagtatatcacgctacaaaaattcataagcactatatttcgaacgttaacctaaatctctcccactaagaaaatggatagaaatgtatatgaagcctgcagcaatataattaaggaatttggaacacatgtagtgagcgccgatgaagtactcgcagaaaaaatagataatgctgttcctataccgttcaaaacaagggaggagatagatgccgacgtggaaaaagatagaaacgaaggagttttcgaaggtaatatcattcctgatatcgacctacgtgtagtacactactacgccacgcagttgtgtctaaataagtatcctcatttgattaacgcctttgatgagacaagccttataacattgggtttactcatcgaaaagtgggtaaaagactatctaaccagcatccagacagaacagggaaggcaaagtaaggtaatcgggaaggggccatgcgaattcatatcaaaacatattgattataggcatgcgccaggtaatatctgaatgtagcaaaaacctggcttttgcggctggggaggatggaaggcttttgtaggctattatctactcgaggaaggaacgttagaatatctccatttttcacgcaaaatgtggttctgagttaatgcgtgtgctgaagcataacatgagttattccctgtatgtatgtacagtatttcaatttcgcagaccgtgggttacatatgtgagcgattaggaagtagtgaagtaattatggcaagtctagaggtccggctgatcccttgcggtgctgaagtaacgaaaccgcgcgcatatcttttggaagagattaatttgcactgaattttcaaacttaattagcgagaagaagtagatgcatttcaattatgccaaaagcagtatttattacttcttatagaatatagtatcacttacgctcatttagtgtacccacttacgtattaaatgacgtactttttttttgtcctcttctgtagctttttttcactttgaaaaatttagcgctgagttcttccaaagacgtcaaatcacctactatagttaaaaacatattacttatactagttctaacacttccttttatctacactgtaatccgaagaatacactataaggatggctagaagaaagaatttcaaaaaagggaacaagaagacttttggtgctcgtgatgactcgagagctcaaaaaaactggtctgaactggtaaaggaaaatgaaaaatgggaaaaatactataagactttagctcttttcccagaagatcaatgggaagaatttaaaaagacatgtcaagctccacttcctctaacttttagaattacaggttctagaaagcatgccggtgaggtcctgaatttgtttaaagaaagacatctaccaaacttgactaatgttgagtttgaaggtgagaagattaaggcccctgtagaattaccttggtatccagaccatcttgcttggcaattggacgttcctaagacggttattagaaagaatgaacaattcgcaaaaactcagagatttttagttgttgaaaatgccgttggtaatatctcaagacaagaagccgtttcaatgattcctccaatcgttctagaagtaaaacctcatcacactgttttagatatgtgtgctgctcctggctccaaaactgctcaattaatcgaagccttgcacaaggatacagatgaaccatctggtttcgttgtagctaatgatgccgatgccagaagatctcatatgttggttcaccaattgaagagattgaacagtgccaacttgatggttgtcaaccatgacgcccaattcttcccacgtatcagattacatggcaactcaaataacaagaatgatgttttaaaatttgacagaatcctgtgtgacgttccatgttctggtgatggtaccatgaggaaaaatgttaatgtttggaaagactggaacacacaagcaggtcttggtttgcatgctgttcagctgaatatattaaacaggggtttgcatcttctaaagaacaacggtagattggtttactcaacctgttctttaaatcctattgaaaatgaagcggttgttgccgaagcgttaagaaagtggggtgacaagattagattagttaactgtgatgataagcttcctggcctaataagatccaagggtgtatccaaatggcctgtctatgacagaaatttgactgagaaaaccaaaggagacgaaggtacactagatagtttcttttcaccatctgaagaagaggcatcgaaattcaatttacaaaattgtatgagggtttatcctcaccaacaaaacacaggcggatttttcattactgttttcgaaaaagtcgaagatagcactgaggcggctacagagaaactatcttctgaaaccccagctctagagtctgaaggacctcaaacaaagaaaataaaggtagaagaagtccaaaagaaagaaagactaccacgtgacgcgaacgaagagccttttgttttcgttgatccacagcacgaagctttaaaagtttgttgggatttctacggcatcgataatattttcgacagaaacacttgtttagtgcgtaacgccactggtgaaccaacaagagtggtttacactgtgtgtccagcattgaaggatgttattcaagcgaatgacgataggttgaagattatttattctggtgtaaaattgtttgtctctcaaagaagtgatatcgaatgttcatggagaatccaaagtgaatcattgccaataatgaaacaccatatgaaatctaatagaattgttgaagctaatttagagatgttaaaacacttgttaatcgaatctttccctaactttgacgacattcgttcgaagaacatcgataatgattttgttgaaaagatgacaaaattaagctctggttgcgcctttattgatgtgtcaagaaatgaccctgccaaagaaaacttattcttgcctgtgtggaaaggcaacaagtgtatcaatttgatggtttgtaaagaagatactcatgagctattatataggatctttggtattgatgcgaatgccaaggctactccaagcgctgaagaaaaagaaaaagaaaaagaaacgactgaatctcccgcagaaactactaccggaacctctactgaagctcctagcgctgctaattgatagttatcatgtttcttatcccctccactgtaaagtaaatgtatattattaaaaggcaaaaataagaatataatacttcagtaatgagccttttttattcggtcttgttacttcttttttacttcatttttttttttttttttggatagtaaataatgcacttttgactagatcttgagtatttagttgaattgaaattaaagatacagtgtataaaaattatacaaaaaataaaggaaacttgtatattgaaaataggattgccaatacatggattgagacagagaattttttatcttcatatccagatattcgtaggaataacaaagttttagtgacccaaggtataaattgcgaaagacctgcggagttggcggcgaacactgactttttgggcatcaacaaaggaatcaactacaactttgatagctctatccaaatcataagaagacacaaattcagataatctcattttagcaaaagattctgcaattcttagaatagattctaaatgacgaactgtgattggaaacgaacctgtagaaatactttctcttctcaaatccgcatataccctgctaaccttatccatatccatctgatgcaatttagggtatatttttgtcctcgcatagtgaatatatttcatcaataattcctgtggaataggcgagatctcttcctccttcttcctttgtctttgaagtcttctttgccttgcattaagctgctcatttatttcatcttctccttgttctatcgccgattcgccattatttttaagctcttcgccttctcgatcttcatcgttttctggatgagatcttacatgagaatcgacaacaaatgtggccaatctttcgtctgcctcttcatcaacaaggtctctgacaacacataaaatatcaaatctagacagaataggctcggtcaaactaacattctgagctaaaggcaaggttgaattatatctaccaccattaggatttgccgcagcaataattgagcagcgcgcttgtaatgtagtaacaataccggccttggaaatggaaatactttgctgttccatagcctcatgaatagatgtacgatcctgatcgttcatcttatcgaattcatcaattaaacaaacacccttatcagccaatactagcgcccccccttctaaggtccattctttagtaataggatcttttctgacggatgctgtcagaccgacagccgaagcaccctgaccagttgcaaagaccgctctatgcgctgttttctcgacgtattttaagatttgagatttggcagtacctggatcacctaataataacacattgatatcaccacgaatagaatgttttccattgacgttttttggaacacctccaaataatgagcacgcgactgcagttttaatatctctatgaccatagatagacggtgccatcgatgatataattttatcaattataccacgatccctagaaatctttctaaattcacgttcttcttcttcagtccaactgaaaacatccaacccttcttcgccttcgttagctgtattgccctctcttctttttatagaatttgcctcgataattgttgcaaaaacggggaatccgttctttgcattcaagttaccatcgtagttatttttgtagatgccggtaacttctacctcttcacctggcttggatacatctaccaaatccgccaacaaaatgacttctctatgtcttggtagacggcctggaggaacggttccgggagcttcctggagcgtaaccctttgataatttcggtacacagttttttctccattgactctaaagggaccttttgatttgcagtttgtacagaatgagattctaatttcttcattagaatcttgaaaaaatgggcccaaaatggagccacatttcaaacaattgaatttgacatattttaattgagggaagactcctgttcttcttgtcaccaccccagtgacgcgtactagagaggacaaattagactcacgcaattcacgtaaactgtatattgttggaaaatcagagattcttacgtgaatttcggagtgaatacgggcataatctgggtaatgcaattctgttgcctccatagccacgagatcgaatattttcaacatttcttctggacatttagctaaaaatagtgccaggatggctttggactccgctaagtgtctataattaacctccaaagattcagaattcatttcacctaatgttctaatacgtgcaccatatacagaacgacccgtttcatctgtatattccagcaggaatgattttaactctctggcaatagttcttgagacattaggttgtgttatccattccgagtaactgttagccttaacgttactcagagattctaaagtaagttcttctcttaatgggtcaatgtccatgtcactcaatagatcgtcatcactattctctaagtcctcatactgccttctccttcttcgtctttgcacaggaaggcccatttcatcaagttgcgctgcaccttcttgttcttcgtcctcgtcatctatgtaggcaacatttctcaatagcctatctctttcatttagttgagcatcaatgcggcgacgttcgcttaaagatagttcttgttgttccctgtcgtcaacttgatctggatcatatctatctctattatgatcagccgcataatcctcatacatattatcgtccatcaaatctacttcgttcatttgttcttcaacttcatcaatatctggtacatcgtcaacttcattatcgtcaccttcagggttaatcatatctggagaaccaataggtgatgaaactgggttcatcccccctctaaaatgttgctgaggtgaggatggcggtagctcattttctgagtccgaatcatcttcctcacgtctacgtcttctattatcagacatcacttatattgtagttgtgttatacttcttagaaaagaggcaaagaggtgtgtggagtattattaagtaaactgtaccaaaatgtgtagattataggatattcaccatttactttctggtttcgtttctcgaaatttttcgttgtcctattttcttcggtaagtaattagatttcctaaaaaaggcatatgataaataatattacacgcgattccgccatcttgggtttcccacatacatacttcacgaagaaaagaaagaatttagtattgtgtaataaaattgatgtttatgtttaaatatttacagaatgtttaaacaggtatttaatccatttagatgaaaagttagtccttttcctttttagcatccaaaatctcaaattcagccttccatactgaattaccttctttcgtattcacatccttgaataatttttggaatatatcattataccaatcagcagctaaaggttccaacccttcctttacattgtctggaagttcctcccaatcatttaagttatctttagggaaaataatagtcttggcaccagatcttttagcggccacagctttttctctcaacccaccgatacgtaaaactttaccggtaagtgtcaattcaccggtcatcgcaaccgttgggtcaatcgacttattcaatgctagggaaaggaaggaagtggccatagtgacacctgcagatggaccatctttaggggtagcaccttcaggacaatgcaagtggatagacgccttttcaaaaaatctgttctcagggaatttttgtgctaaatacatcttggcgaatgaataagcaagccttgatgattccttcataacatctcccagttgcccggtcctttcaaatgttggatgcttgcagttgtgtaaaggttgttcaaggacagattctacataaagtgagcaacctcccatattagtccacgccaaccccataactacccctggtggagttgtttcgtataaccggtctgtagtgtagactggaggcccaacgtaatcttttaggtttttctgggatatggaaacattgatcttttcagaggtctttaaggcttcaatgtcatcgcttgtcttttccgaattattgtccttagtcttctccgatgagcttttggcgttattttccgccttttcttcggaagaaacgctttctttaggcttgctgtcggctgatgacgttggggaatcttcaatactcaacttctttaccacttgtagggctgctttacggtatattttctcgatgtgttttttcaaattccttacaccactttctctacagtagtacttcattaacgctgttattgcatcttctgtcatatcaacatgagagttttctagaccagcgcttttcttggcacttggaactaaatactgctcggcaatcttaaccttgtcttcagcaacatatcctgtcaactcaatgacttccatacgatccagtaaaggtcttggaatagtttccaaagagttagcagtgcaaacgaaaagcacttttgataagtcaataggaatatccaagtagttatccaagaagctgttgttttgttcagggtccaatacttctaacaatgccgcggacggatcgccgtgtatgccgccgtgtccaatcttatcgatttcatctatcaaaatcaaaggattttgagtttggcacttctttaatgcttgaactactctgccaggtaaggcaccaatatacgttctcctatgaccttttatttctgccacgtccgtcataccgcctacagaaaatcggaagaatttcctgttaagagctctagcgatagatttacctatggacgttttaccaacacctgggggtcctacgaaacatatgattttaccatcgactttacccaatagtttaccgacggcaataaactccaagatacgatccttgacatctaccataccataatgatcttcatctaaaattttctttgctctcggaatggaatactgttctttggaatgttttccccatgggatcgatgttaaccaatccaaatagtttctgataacgccaaattcggacatagaagtctccaaggtacttaatttagttatctcatcatcgaaaattttttgaacgctatcaggcaattttaatgacttgattctttctttataagtgtcaatcaatttgtcacggccgtcgtcaatacctaattctcttttgatgccctttaattgttccatcaaatagtattctctttgtctcttttgaatctttgtctctacatctttggagattttgttctgtaattcggcattcatcaattctttcttaaggactagtagcgacttttctagtctgtgctcaatgtttaaagatgacagtatgtcttgtaattcgtcttcttcgccggcagaaacagcagcggcaaaatctgccaatctagctggttcctcaaaaatgttcgtggtcgcagattgaattgaagcagaaaaagttgcaatttgttctctgaacatcgtgttcaattgagaaatttctttaaataccttcaatatttctgatgttagcgcattaataacgggtgactttctatcaaacggttcatcttctaaattcaacacattgacaagggaaacattataattttttaagaattctgtggggttaatgtcctcaccttcttgaatatcgtctaattcttcagactcttcttcagtggcttctactctcttatgatgttgcaattctgagtctggtatcctctccaccacaatatcctccaacttaggcgtagcagggctggtgctttcttggtcttctgggttgttagcgtcttcaacgacggtcgtttcagtatccgtatcctttgcttgttcttttgatttttccttttcctcgtttggtggaaataattcatcaatttttattctcctgtgaggatataaaagagcagtcattgtttcagtgcccgtcttttcgtctttactcgggaaagcgctagttatttgagccagaacaccaacatcgtatacatcatttttatctgtgattacatcagtatcttcttccgagttcttcaacatgaaagcgccaatgtagggttgctggcggtctaacatttccttgattgccttcataactctttcgtccgatatcacaaccgccttgtagaaccctggaaataagggccgtctggctattggtaatgctagcatttgcgggtatacttctggtacatcctttggaggcttttgtttcgaacttccatctccagaatccgatcgactggatgatgactgtccacctccagaagcggagcttctggagtttttcgaagcttcaccttcttggtccttattaacaatttcatcatctcgcgtgggctcaacatcattgtctgtatctttttcatcaggtactatcttgacatcttcatcctttttctgagatgtactatcatctttcgccagaatacttttgccgctgtttgtagccatgaaatgccgagcaaactgtgcatcaagttgtgcaaagtgttccatgtaccttggatccttcaattgatgctggaactcttgccatgttggactcttaataatatggctaggtttgatattctctacgtcacgcacggtcaaggtcgatgcgaaccttctttgagaaactgcagcagtcttagcgatagatcggtaatattggatagctcttgtggtcctcgccactgtgctaagggtctttgtggttcttgttcttagcatgctctatttgcaaatcttttcgttcaagcacctcgaaaaccaaaagaaaaaacaactaaactttgaaacagctgcaaatgcacactgtattatcaggttttaggtgtcctagtaaccgtatcagcttgtcgttgctgcaataccaatgcaaaagcatggctaaaagacttcgtctgacttatttccttccggtggcaaacatcatacaccctttacaaagcacccatacattacattgaatacattacacactaacaataaaatattatctatatcgttacattcattaattacacgagaaccaacgaccagcaggaaatagccccgtgctattccatcctgacagctagcaacttttgcgatctaccacctggttttgtcttctcaaggcacctcttcgtcgtcctgctcatacattagttgattcttcagcgcctgttgttgcctgtatttagccaagtagattttcaacacctctgcatagttctcgaatcctaaggcgtgcaatgatatgagaatgtcttccccgtttatcgtctttcttttgtcagcagcgcatcgatcgctggcctcgctagtcacaaaagaaatgagctcactgacacactcctgcatgcactctttcgcatctttcgataccttagcactcggtgggagagtattcttcatgagtcgcgctacattgttgatgggtagccatctgtcctgctctcttagcgtggaaatttgctgcaaactgccgctggagctagcgtttccaccgttctcctgagtatcctctgggcttgtgctaacatgttcggactcgttggtattcatattctcgagaggtttgtgccacttgtgttactatctagcttagtcctgctcttgagtttgattggcggaaagctactattcgcagctctttttttacttagtctgaaagagcggaccaaaaaacgcacgtagcgcgatattgtcgtggcatcgaacgtaatatggtacttctattgtgctatattttggcagaaggtttgcagtaatcgcagcctggagaagacaatgcgtattagtagcagtaaagggccacagatagggtgatttgaagttgattctgcttttgtcagtgaaggaaaagaaaaaatggcgaaaaaaaactcacaattgccctctactagtgagcagatcttggaaaggtccacaacaggagctaccttcctcatgatgggccaacttttcaccaaactggtaacgttcatactaaataatttgttgatcaggtttctgtcgcccagaattttcggtatcacggcctttctagaatttatacagggcacagtgttattttttagcagagatgcgattcgtctgtcgacgttgagaatctcagactccggtaatggaataatcgatgatgacgacgaggaggagtaccaggaaactcattacaagtctaaagttttgcaaaccgcagtcaattttgcttacattccgttttggatcgggtttccactgtccattggtcttatcgcctggcagtacagaaacatcaacgcgtatttcatcactcttccattcttcaggtggtcgatttttcttatctggctgagtatcatcgtggagctgttaagcgagccattcttcatcgtcaaccagtttatgttgaactatgccgcaaggtcaagatttgaaagcatcgcggtgactacaggatgtattgtcaattttatagttgtttatgccgttcagcaatcccgctacccaatgggggttgtcacatcggacattgacaaagaaggcatcgccatattggcatttgccttgggaaagttagcacattcgatcaccctgctagcatgttactactgggactatctcaagaatttcaaaccaaagaaattgttcagtaccaggctaacgaagataaaaacgcgtgaaaataacgaattgaagaaaggctacccaaagagcacatcttattttttccaaaacgacattttacagcacttcaaaaaagtttattttcaactatgttttaagcatttgttgacagagggtgataagttgattatcaattctttatgtactgtggaagaacaaggcatttacgctctattgtcgaactatggatcgctactaacaagattattatttgcgccgatcgaagaatctctgcggttatttttggcccgtttattatcctcgcataaccctaaaaatttaaaactatctattgaagtcctggtgaatttaacaaggttttacatatacttatcgttaatgatcattgtatttgggcctgccaattcatcctttttattgcagttcttgattggctcgaaatggtccactacttccgttttggacactataagagtctactgcttttacatcccatttttatcgcttaatggtatttttgaagcttttttccagagtgtagccactggtgaccaaattttgaaacattcatattttatgatggccttttctggtattttcctgctcaattcctggcttcttattgaaaaactcaaactatcaatcgaaggcttgatattgagtaacatcattaacatggtgttgagaatattgtattgtggagttttcttgaataaatttcatagggaactgtttacagattcctcttttttcttcaattttaaggatttcaaaacagttattattgctggctcaacgatctgtctacttgactggtggtttattgggtacgttaaaaatttacaacaatttgttgttaacgtattattcgcaatgggattgttagcgttaattttggtcaaggagcgccaaaccatacaatcttttattaacaagagggcggtttccaattctaaagatgtataaacaaaaattcttatataacttaggcgacacataatatgcgcttaaataacatatagtgagtatattatcaaaaagcattcatttttttttatttattagtccttcagaaagttagtttgtatgtactatatgatgtgaaagtgctgaaaaattacccaataaaagataggcaaccaagagagaagctatttcaccgtaaagaaaatccctttccttgtcaggacactatgtcatcaagcgaaaacacgttactggatggaaagtcagagaacacaatacgatttttaactttcaatgtcaatggtataagaaccttttttcattatcaaccattttctcaaatgaatcaatcccttagatctgttttcgacttttttcgagcagacataataacattccaagagctcaagacggaaaaattgtctatctctaagtgggggagagttgatggtttttattcttttatttctatccctcaaaccagaaagggatattctggcgttggctgctggattagaattccggaaaagaaccacccactataccatgcattacaagtcgttaaggcagaagaaggtataacgggttacttgacaataaaaaatggtaagcattcagcaatctcctatagaaacgacgtaaatcaaggaattggtggttacgattctttagatcccgatttagatgagaaaagtgcactggaactagattcagaaggcagatgtgttatggttgaactggcatgtggaatagttattatcagtgtatattgtcccgcaaattcgaactcatcggaggagggtgagatgtttagattaaggttcttgaaagttttattaagaagagttcggaatttggacaaaattgggaagaagattgtgctaatgggcgacgtaaatgtttgccgggatcttatagacagtgccgatacattagaacaattctcaattccaataacagatcccatgggtggaacaaagttagaagcacaatatagggataaagcaatccaatttattatcaatccggacacgccacatcggaggatatttaatcaaatattggctgattcacttttaccagacgcgagtaaaagggggatactgatagacactacgaggctaattcaaacaagaaatcgacttaaaatgtatacagtctggaatatgttaaaaaatttaagaccttcgaattatggctcacggatagattttatcctagtgtccttaaagcttgaacgatgcataaaagcagctgacattcttccggatatattgggctctgaccattgtcctgtgtattctgatttagatatactggacgacagaattgaacctggtacgacacaagttcccataccaaaattcgaagcaaggtacaaatataatttaagaaaccataatgttttagagatgtttgccaaaaaggatacgaataaagaatctaataaacaaaaatattgtgtatcaaaagtcatgaataccaaaaaaaacagcaacatcaaaaacaaatcgctcgactcatttttccagaaggtaaatggagaaaaagatgacaggattaaagaatcctctgaaattccacagcaagctaaaaaaagaatctccacgccaaagttgaatttcaaggatgtctttggaaagcctcccctgtgcaggcatggggaggaatccatgctgaaaacatcgaaaacttcggccaatccaggtagaaagttctggatttgcaagagatctcggggtgattcaaataatacagaatcatcttgtgggttttttcagtgggtttaaatatgaaaacgtcagctgatattttgggagaataaaacactttcttctatgcccaagtttttttaaataataaactgatattctatatacatttacagtcttgttcttcttcttccattacttttttcagccataggcggtcatcgtcagtaacctccagaagtctcaaactggaagattcttgtagaattgacactgttaatggtgaaccgacgagttcatcagtagatatgtatgtactgatggacgaagaaaatgtatctttatccgcatgatttactctgatgtaagccagcttatcgtcaacatgcaggaatgaatattctacaccttcaccaaaaataccataactacgtttcaatgcgttatttaaccattgcctccatgtcatttgatcaatagcatgtgcatcgtccacatcttgatcgaatgaagtactataaatattaaagtacgttagtagtttatttctcttcggtagttgagactcaaaaagtcaaaaatatacatacattgataacttgaaatattgccattctctaaaagtctttttccccatcacaactggccatttatcaaactatttatctgccttttcttattctgattatcctataaagctgaacagtaaagcttgtaaaattacgcgatgacttatgtattgaagttatgacgttctcgatgatcttcagtcaaacaaccactttcccgtaacatatgatatatcccacccgcttccttgtacgcattattacggttctgctttgaagatggagattcagtacttgcagttatttgaattgcaccagtactgatcatgccaagtttctttggcttgtgaaagaacttgatattctgtctaaaggatctgctcgtttttgtttatgaaaagtatatggaattatctactctatgtaaagtaatctctctactggttttcgttagatggcgctgtagaatcaggcctgtcgatgttttcctcatttccttctggtaatgtatctggaacatcggtggtcgtaggttgatctgtatatgatgtatgctcttcttcaagtgttggaacatcatcttcttcgatttcaaaattactaccctgatccatgaaactggataagtcattggcgtcttcatcgtggccagcaagcaggtcatctgcttcatccaaaaattgatcatggatcagggatgagtagcttggacctgttctgtttccaaaccttcctctaattttggagatagcatgcgctatattagtttttgtgtgctgtaaaagagacccgatatttgagaaaacgtaaaatcctgatttcacaatgttattgacaactctgtcagtattattgttttctattaaaccatcgtcacctagcctaatttctccaaaccttgcaaatcccccatttcttctgatacctctgtcatatacaaaccatgcggcaaagaaaattattaaaagaattgaaatgaaaataaatgcaaagggaccggcacttactgagtacttttccttgaattctttttcttttcctgggcaagcatgtggtgatgagggagcatccaatttcaggccaccctcacaggttgatagagggatctttctgtagcctgacgattcaaaatattcgattaaatctggctcttttttacaaacgtctgcagcatttgctgggcttagtcctttgactaatttacaagtaccatcgttagctttgtaaaagttgtaatcacactcgaaatcttgtcttgtacaagaacagtttttgatatttcttgaaaattcagaaagtggaatattcccaataaaacaattttcatcggttttacgtaaaaactcggtttggtgaccaaataggcaattgcttttggaacccagaggagagtatttataatctgcgctttccttaccagtgatgtcgaaatcacattgtctttcgaagatgtttctaaaatcaattgtgtacgttctaaatgagctgcctccaatatctgctgcctctccaaacagcaaaaatctcaaagcagaatccctgggaacagtggttatatcctttactaaaaccttatcagcgcagaatttataatctttccatgttttaccaaaatcggtagaataggaaatagaatcagtttctgagttttcaggaactaaaactaaaatcccaccgtggtcaccgtattcccattggtgaggagtcttcttaacttcagcccacgtttcgccaccatcggtggtgaagaaggtggaacattctttatatggtaaaaggttaggaccaacgttgccaacgccgaacatcattcctaatgcagaaccggaagaatatgtatctctaatatccttacgttcagtatagccatgtaagtgcaatgaacactcatccagtgatttggagctgcaagaaaacttttttccttctgaatccctcttcggaggtttcaaaaagttccaatctgaaccttcattaaaggtgatcttcgtcttcaattgtttgtcttctttattctcggcgaccttgtcactatttgaaacgatgttggtgagaataatgccttcgagaccttgaattttttcaaagtcaacatagccgaatgtgtttctattaacggcatgctccaacgtgacaaaagaagtaccatttgagttggatttcaaaagattgccaaaatcgcgtcctggtactaagtttgttgctaaatgtaagaatatcgatcctttctcagactctaatatagtgaatgcctcttgcttcccaacatcttcatcatatgggaattttgcctcggcaaactcagtaccatcgatagttacgtatgctctcaattcgttgttctcatgaggaacagcaacgatgatatagccaccagtggataagtagccgataatattttcaaagacggtatttttatcatcctggaaaaaatcagtagaagaaactaagcttcttgtctgcgaagacttttccttcacttgacacataaccatatcctcatttgacggatatttgaaaagtgagcccgcaaactcacaatgaattgcattatcaagcatttccgtaaacgtttcgcccccatcattggtcaggtatgctaccgcatgacattccggacttaagattgactcacaattcttaccaccataatagataaatgtatcctgtgccttagcgttaaagtctaatggcatacctaactgcctagcctcgggcaatttagcagtcataaaagagtatcccctatcatgggtagagaaaatgctacctttggaaccaaacagataagctgaagaattgtagtatggattaaacacaacttcaataattgtttcaccattactgtcgaacctttttattgtttgtccaccatcatgagatatataagcttctcctcttgaattgatcatgaggagggattcgtcggtgactgtgtcaaagtattgatagaattgaatcttgaaatcaaatttgttttctgtaaccactatttctttatcattcgttcccttctttggaactccctcacacgaaatatccactgatttgactgtcattggttttttacatttatcacctttaactagttgcaatggttttacaggcacagtttttttctttgtcttatcacatacgtcagagagaacgattaggttgtagtctggtacgcatttcccggtcgcgtccctaacaaattcaaacgcgcattcgtaatcagcctcggtacacttgtcacaagcagtctcaaataattgtaagtcttcaaaaactttcttcaccaagcactgagcgtcctgttttcttcttctgatcttgtacttgactccattgacacacttcccctcagctaaattccaatcctcgaaatcattttcttcgcatgtcttatcattaaaggctgttgaaaaatcaattgcatagatgaaattcgttgtaccatccatatgcgccaaagtaaacccatttagaataaatttagctccagatccgtcgggcgttgtattcattacttcatttgggtagatagtagtttctagctgatattcggtccaagttttaccttggtctaaagagtaataaaattcggattgaggatcgtcgtcttcatccgcattatacggtatagccacaataacatttccgtaatcaccaacagcgtataaacaaggaaaatcaaaggcgagtttccatgttaagccaccatccctagaaataaaggttctttgatctccccagtcgaagacactaccatcgccaacaatacctgttgtcattagaattccggcggttggagtggaaccctcccgtgtgtaaaacatattttgaagcgaacaattctcaaaatcagtaatatcacagtcgaatgagtctgcgttatctggatcaacaacttttaacattgtccatgtgaggccattatcaacagatattttggttacccccttactctttactcctttggcttttcctttacggttacgacgcctagatagagggtaaagtgaggcaatcatcgttcctttcaagtaagtaggttgataaaaattaatataaccaaacacctcatttgcggtccatgggatgggggaaaattttaacccttgtgagtcggaaattaaaatttcagacacgatgcccttatcctcctcttgatcacttctttccctactcatgggcaagataattcttcccatagcgtcctcatatatttctccttgcatagaatgccttaactgagtaggcatgtaagccattttaaagtttgacagatcatttgatacccacacatccatggaagacatatcattatatctgtcgccctgggttaagacaaccatgtgagatttcaatatcctgtaaccattgacgaccttatctttaaattggtcaaattcttttagtgatttgccccagtccgtagttaggaccaatttactttcggtgtaaggagaactaaactcatccataataagctgcatattttgaaaaagacagattattgaggtatcactactttcaaggtcagaatctttgctggtcttggcaaagccacaatcagaaatgctgataggactattttcgttcctttctagagaagacttgatctcagaaaaggattttccaccatcattacttgcaaaaaccttgtctgtgcaacgtgtaatattaaatatttcaaattgtccctcttcgtcccccgaattctcttcattgtcattgtttacttctgttttctcacaatagttgcactttgcaagaaaatagttcttattcaagggatgggtttctatatagcattcacgaggtgaaatactttctccggagtcaggtagcgttatacgctcccatgacttaccttgatcattggttatataaaggtacgacccattcattgccgttgcaacggctctgtcatgtctattgaaggggtcgatgtatatccaagtgatttcgccttcaatgccttcaactttttcccatgtttcaccatcgtcaaagcttatagtaacggaggtgtcttgttttctaattaaagtgttggaatcatcaaagcttaatatatcaaatgaatcttgcgcgatagtctttgtcactttgggggtgaattcttcggcattagttaaaggaatgagaagtaaggcccaaagagaatagacaaaatgaagtaatatcataacgtgtgatgactactggacacttcagggcttttccagatatacagagctttataatacaatctaagggcaaaataaaaaaggaaaaagagtacggtagttgagaaaaaaaccggaaaggaattgctttaaagatcttagtagaatgaaatagtaccacctactcgcctcctttttttgtgcttcttgagaggtcttttgagctgttgcatcatgctgttatttagaggttattttttgaccttggtttttccttcttttcgccgtactcagcccgagaaaaaagcagcgactgcactaaactagaggaaagaaggcttaaaacatcacgcgatccatataaagacccgagtagttggagagattgactacttgacgttcaaaagaacatacataaggataaattcgttcggactttttaacttacacacatcttttggtgttcattcaaggggcggtagtgcttgtagtccgcacaggcggatactttttagtttgggaagagttaactggagagggcagtttactttcacatactcttttatctttctgaagtaaaatgtgatgtacctacaagcaatgcataagctcttgagttttagatctgtttcaccctggaactcaaaattcttttactcgaaatttttactttttttttttttgtttctgcattctctcagattttagatgatgcggttttttacagggcattgaaacaattgcagaaaagcaacatactaatatatcataactttttactcttgcctctcagaaactatatatacgttgtaatcattttctttcttctaatagctagttcgtttgaactacaaggaaataaggcagagaaaaagaaaggaaaataatatgccaaagagaattgtatacaatatatccagtgacttccagttgaagtcgttactgggagagggtgcatacggtgtggtatgttctgcaacgcataagcccacgggagaaatcgtggcaataaaaaagatcgaaccattcgataagcctttgttcgcattacgtacgctgcgtgaaataaagatcctgaagcacttcaagcacgaaaatatcataacaatcttcaacattcaacgccctgactcgttcgaaaacttcaatgaggtctacataattcaagagctaatgcagacagatttacaccgtgtaatctccacccagatgctgagtgacgatcatatacaatattttatataccaaaccttgagagcagtgaaagtgctgcatggttcgaacgtcatccatcgtgatttaaagccctccaaccttctcataaactccaactgtgacttgaaagtatgtgatttcggtttagcaagaatcattgacgagtcagccgcggacaattcagagcccacaggtcagcaaagcggcatgaccgagtatgtggccacacgttggtacagggcgccagaggtgatgttaacctctgccaaatactcaagggccatggacgtgtggtcctgcggatgtattctcgctgaacttttcttaagacggccaatcttccctggcagagattatcgccatcaactactactgatattcggtatcatcggtacacctcactcagataatgatttgcggtgtatagagtcacccagggctagagagtacataaagtcgcttcccatgtaccctgccgcgccactggagaagatgttccctcgagtcaacccgaaaggcatagatcttttacagcgtatgcttgtttttgaccctgcgaagaggattactgctaaggaggcactggagcatccgtatttgcaaacataccacgatccaaacgacgaacctgaaggcgaacccatcccacccagcttcttcgagtttgatcactacaaggaggcactaacgacgaaagacctcaagaaactcatttggaacgaaatatttagttagccatcattatcattaaaatatcaacccgaagaacaatgtatacatatacatatacgtacacatatacatatgtacatatgacatacgtattagccgctgaggacgcggacgtataaaaggacaatacttatatggagctaaggggagcagttacgcaactccgtgatcgcgcgccacgggccgtcggcggctgttaattgaagaaaaaaaaaatgaagaaccacaaggggtgatccatataggtgactagcatcatcccctgcgacgcgcggcccgccgggccaaaggcgggcaatgcgcgctgctgattggcctcgaggacaacgccctcaaccacatccgcaacagccaatcccatcggagcgtcaaactaccaaagtagtgattgtatggatgaccactgtattgtggacggtaagcgcttgctggagcaaatgtgtaatcaagttgctgtgtatatatagacgttagatgtgttctaccccttcttttgtcttgtgcccaccgggcttacattagcacacaaagcagcaagagaccgtcttactagacaatagcggcaaaacaaacaacacatttctttttttctttttcacatattgcactaaaatgacaatttctaatttgttaaagcagagagttaggtatgctccctatctgaaaaaagttaaggaagctcacgagcttattccattgttcaagaatggtcagtaccttgggtggtccggttttacaggagtgggtactcccaaggcagtgccggaggcactgatagatcacgtggagaagaacaatttacaagggaagttgagattcaacctttttgttggagcttctgctggtccagaggaaaaccgttgggctgaacacgacatgatcattaagagagcccctcatcaagtagggaaacccattgcaaaggcaattaaccagggtagaattgagttctttgataaacatctgtccatgttccctcaggatctgacatacgggttctacaccagggaaagaaaagacaacaaaatccttgattatactataatcgaggcaacggccattaaagaggacgggtctatcgtcccaggtccctctgtcggtggttctccagaattcattacagtcagtgataaagtgattattgaggttaacacggctacgccttcgttcgagggtattcacgatatagacatgcccgtgaacccacctttcaggaaaccatacccatatctgaaagtggacgacaagtgtggtgttgactccatcccggttgatcctgaaaaggttgttgcgattgtggagtccaccatgagggaccaggtcccaccaaatacgccctctgacgacatgtccagggctattgcaggtcatttggtcgagtttttcagaaacgaggtaaaacatggtaggctacctgaaaacctgctgcctttacaaagtggtataggtaacattgctaacgctgtcattgaagggcttgctggcgcccaattcaagcacttgactgtatggacggaagtgctgcaggactcgttcttggatcttttcgagaacggatctttggactacgccactgctacttccgtgagattgactgaaaagggtttcgacagagcctttgcaaactgggaaaatttcaaacacagattgtgtttgagatctcaagttgtctcgaacaatccggaaatgatccgtagattgggtgtcatcgccatgaataccccagtagaagttgacatttacgcgcacgccaattctacaaatgtgaatggttcccgtatgttgaacgggttgggtggatctgctgatttcttgagaaatgcaaagttgtccatcatgcatgccccctctgcaagaccaactaaagtagaccctaccggtatctctaccattgttcctatggcctctcatgtagatcaaactgagcatgacctggacatcttggtcactgaccaaggtttggcggatctaagaggtctatcgcctaaggaaagagcccgtgaaatcatcaacaagtgtgctcatcccgattatcaagctttgttgaccgattacttggacagagcagagcattacgctaaaaagcacaattgcttgcatgaaccacacatgctaaagaatgctttcaagttccacaccaacttagctgaaaagggtacaatgaaggtcgacagctgggaaccagttgactagtgtttgtgcgcaaaccgagagatgagtatttaacaaaaaaaagaaaggaaatgatatgattatgattttatgtttataaagcttttatccaatgcgttgttttttcttgcatatttatactttttgcgctcatggagggagttaatcaatacgcatgacgtctagttaattcacaggtagtactgtatatttatatgtttacacaataattatgtattaagtagtgattagtaaaaaaaactaagaggttgaaagtcatcaacccttatattaatttcaacgaatttcgctgatgacgtcagggtagttctcttgcttaggtcaatgtaaaaatgccagggtaatacaaaaccaagctctgaaccgcccaacttatctgtaatgatgcatgtataccttacaatgattttttttctcctattatggaattaatattggaatccatgtttgtgaacagccttctccgcaatttagcttcaagctaataagtggttattgtttgcgcgcgcttgaaggcaaggatcatcgcttttttcttctcaccattgaatttaagggacgccgattagcataatacacttatcaacaacaaccggatgtgtgttatctatcagtggtggaaggattggtaagcaatttggtttgatccagaggactaagaaaaaaaaaacggctcatcaaagaaattagttcaattgagtggtttaatagacaaagtttggaaagataacagaagtagaaaaagtaaaaatctacacatgacactcaacacatgtggacagcaagagggcagatagataagtcgacactgcaaattgttgtgtatgtaatagccctgggtgcaggttggccaaaactgttcaacagctcgcccatttgaaggttcaacaggccgccagaaatgttcaacagattgtgccgctatgatacgtaacttatatatagcagcgtgtataatattaggaccataataaaatgaatggcatgaaaataacgacaacaatctcaacagcaaacaaattcacaatacagtcatgggcagcataaacttcatatttgctttacatcttttagttgttttatttttcatcatcgccatccctagctacgccatgtatccatttttaccatttatccttacatcgctcgtatttgctcgttctgataactctaataatcgttattgacaagttggttcaaggtcaaaaattttgttattacaatcactgagcaatacgctgtttttccatagtatggaggcatttttttttctgtgaatgtacgtatattttactgtatacttcattaatatttgggaaatagacatattttaagattattttttagatcctgtttacgtaaaagacaataatataggtgtgtaaattataccctaagttcttctcaaggatgtaagacttccacaagagaaccggcaattttatatgataatactattttttctttggctttacatgtagtcgtttattatcctattgaatcagcaattatcacatctcagctttcattacttttgatgactgtttctcaactccatgtcattcttacactgtgtatgatactaatcgatagatgatcgttgattattccttcaacagattctgtctaaaaaatggtaaaactgttgctactaatcaatatcatataattgatccttattcaacaatatctacaacgaaaaaggagattaaaaaaatgcatgctaagtaaatgaaggttttcatctgtccctgatgtttttcttcttcaagcacgttaaccagtaatcaaggtctcttggcccagttggttaaggcaccgtgctaataacgcggggatcagcggttcgatcccgctagagaccatttttttgcaattcaaataacgtcgtttattttttatataaaaataaaaatcaaaaagaattgcgcaagcccggaatcgaaccgggggcccaacgatggcaacgttggattttaccactaaaccacttgcgcttatttcttggaagtgttgtatctcaaaatgagatacgtcagtatgacaatacgtcatcctgaacgttcataaaacacatatgaaacaaccttataacaaaacgaacaacatgagataaaacccggccttccctagctgaactacccaaaagtataaatgcctgaacaattagtttagatccgagattccgcgcttccaccacttagtatgattcatattttatataatatataagataagtaacattccgtgaattaatctgataaaccgttttgacaactggttacttccctaagactgttcatattaggattgtcaagacactccgatattactcgagcccgtaatacaacactttttttggtaagtagtttataataacatgtgttgaaagataacaaatgccacaaaatatcaatggctacttaaaagggtaattgcaaaccattggaatgaaatcctaatatcatcttcttacaccgcacgtgataataaactagtaacacgaatacaactaaacagatgatattatagactttcattccaacacatctgttgactagtaagatggatattagtcaatagatgatgtttcttattccaaactatcatgggtttgtaagaaaatttattttgaggggaattgattacatttcctttttttttcaatgtactttgaagttttttcttgtttaacaataagcttgcctaatcattaaattagtgcataaaaaaaaaggtaagccgagattaaataagtaaacaaagacatactaaaaaaaatcattctggtacatacagcattctagttaatgttagattagcagtggaacattccatatttaatcttgtatcattattaaaataaggataagtctgagaagtccattcaaccgggacttaaccgccactttaattaaatctatgcaggattacccttgtgtaggccacataaaatttactggagatttctgtccggaaagttattgaaagcttttaagtatacttaaatgatttctcttttccatttctacgttgcccttttatcaatcttattgtggcatcgatccttgtacgtctacttattccattatttgatgaaaattgaatcccgtctctccggtcatattattttcttcaccttttactgccgtatacaaatattccctctcgacgtgtaccatcattttgatccgtgacatagtaggaatagatggattatggtcgattgagcttccaatactttgcgtattgagcaagctatgcaaattaaaatatctataaactgataggaaatgtatatactgaagaaaatgtttattacttgttacattgttttgattacctgtgcacgcattataccttatccaaacccccggatccttttcttcttctttttggctttttgagaattacgcggttgtgaatcgttcacaaatgatatctgcgaggaagggggctgcattagagtaaatgctggtgtcattgaatctggcaggacacttaagttttgagtggattgtgataacggagtagctttttgtgattgtgtctttaatattcttttcctccttgccagtccgctactttgtgatgatttgatcgttggaatttgagattgcgaatttaaattaaatggaggcctgccattaaagggtgctgaaaattgactatcaaaattaaattcattagattcatcttcttcattgatatcatccatatcccaagaggagataatatcctggtaaggaccacttagtgatcgtgaaatttcgttttgaatcggttcaaaaagtgatggtttttcaagtctcgctaaactccagataatgtctttgactatctcctttgtcagcagttccgcttgcggggataccaaaacccaacattgcaataatttgttgtaaaagatatccaagcccggaacgtcttcatgtaaaaacaaatgtagcaatttctcaaaaccaataaatgtcacatcctgatcctgatagtactggaaaaactgatctagtaatgaagaaaattcaggtatactcgcgaaggaatctgaattctccaaaaggtttttcaattttgaatggctcaaagacccactaaggatgctttcatctttcgtcttctgccaagattcaagcaattcgtttgtagctatagataagcgatatcccaaatcttggagatatttatcttcgtcgtgactgttttcatgctcaattaaattttggactcgagatatgcgctctctttccttcaacttaatttgagaaaccagtgcaccgatactctccttttcacgttcatcagcgttattgaaaagtgacgcccattcgggatggtcgacaatgatgggggtttcttgtttgttcggttcggagttttgagtgtttgataaagcatagtaataaacctcggatgagttccttagtttgactaaaaaatctacaactaactcaaaattttcatctgcatcctcctctctccgagattcatcgtctatatgatccagtgttaagattgtctctataccggtgggggtcccacccggaatttcaagaactgttgagcatcctaaggattgaaacaagtttgctttcctatgggaaaatacatgcatatagatgcgtttatgccgcatcgaatatacaaaggccaccagaagaatatggtcaggctttttaaccttttgtacagtgattctgagcgtagtatcatctggatccagatcgtgtttccaagatattcttctcactggatcatttgattctgatgcccctacgatgattatttcccttgaagtgagtaaaataccatttttatcatctatccgcttataatcacgtatgtttgaccatgctttcgcttgtactacttccgtttgccaattgttcataaagtcgatctcaatcattttggacctatcaaagaccagtattttttggaagtgtgaaaaccattctattcttttccatgacgataattcttctggatcaaaaatcgtaccgtggaggttatctattaactgtagtttccttttgttattattattgaaattctttggtatcctcccgatactccagttaccttttatatcaatgattgcgaattgttgtaagtcccaaggattgaatgcaaaatctaccacctgaaggtcgtctatttcaacaaaatacagtggttctgaactactaaccatgacatcacatgatcttgagtggacactttcaattctaaagatttggaaagaattttcggtgattatgcccaccaggtttgatctccgcccgatggactcagaggcccccggtatcttaatactcttgataggtgaatgcaattcgatactcgttacattgttatgtcggtttaaatgcaatgtattttgtcgtgtcagaactgctatatttaggactgagcctgttttacccgaggcatatgctatgatttcggttccgtctctataatttcttaaatctgatgctgtctgaatatattgagagtccagtcgattagccacagtaggatcccaaaagaaggcgtcttgcatcggcctcgaagagttagtactttcttgtaatgtatcatctaagttgcgcagcaaatctgaaggaatgtaatcttgaaatgaaactggcgtatcgcagttcacaccaaacatagaatcattaccaacgtcaactttcttaaaaaaatggacatctttcggtaccacgggtatcactggattgaccactatagatgtatccccctgattgtccgtatcttcatcaatatcgctagttatgagatcatcgtcggcatctgattcttgcaaaaccttgtcgtcggaaatatatcttatggcagtatcacaaagcagacttttgaccactatatgaaggtctagtgcatcctcggccaatgtatcatctactggtcttagccattgtgggttttcttgcttcttcgtagtgtaattttcttgcggacagtaaagactggcgccttgtacaccaacacccaattgcgagcctaacacatctgagcttggaatttgtccctcactcatgctcagcccatagaacgccttctctctttacttcaacttgccacatcaatatcattaccaaactaatatgaaagctcatctcggtttcttaatcgagagaataaaaattatcgtatgcccacagggtaacccatatttatatcaaatggaagaagcgtccattaagaaaaaagcaaaaaaagctgtacctgctattatggagaggagtaagcgcttttctcattaacgtaaaaagagaggtaagaaaaaaaaggaaggggacctaggcacctcatagtgagaagattgaaaacggcgtatcaaacaaatggttaaaatgagaagaataacacctacacgcctcctattcacatgcagatatatttcaaacaatgcttctccaccagtgcagcccttgaatgtgcttttctttggtagcgacactttcagtaatttctcattgcaagcactcaatgagttgcgtcaaaataatggaagctgtggtatagtggacaatattcaagtagtaactaggtcgccgaagtggtgcggtagacagaagtctattttgaaatacccgccgatcttcgatatggcagagaagcttcaattgccacgcccaattacatgcgacaccaagcaggaaatgttggcgctaagcaaactgacacccagtcgccaaggaaatccggagaacgacggctccggtgctccgttcaacgcgatcattgcggtttcttttgggaagctcattccgggtgacttgatccgcgcggtgccattggcgctaaacgtccatccttcgctacttcccagacataaaggcagtgcacctatccagcgagctctgctcgagggtgacacttacaccggtgtaactatacagacactgcatccggatcggtttgaccatggtgcaattgtagcgcagacggagccactggcgatcgcaacaatgctgtcaaaagggagagtcaatgattcgacggcagattttaattctgagggcctgcctcggaggactgccatactgatggaccagttgggcgcccttggcgcccaacttttgggccaaacgcttcgtgagaggttatatctaccacagaaccgtgtgcaagcgccaacagcttacaaacccagttacgcccaccgtataacaacagaagataaacgcattcattgggcgcgcgattctgccgccgaactacttaacaaactcgaaacgctcggtcctctgcacgcgttcaaagaagcgacagcggcaagaaaggacgctcaaaattcagtattaaaacgaatattgtttcatgagtgtaaagtgatgagagacgcacgtctagataatggcagtaaaccgggcatgttcaaatatgatgatattaaagactgtattttggtcacctgtcgcggcaacttactactatgtgtgagccgcctccagttcgaaggtttcgccgtagaacgtgctggccagttcatggcgcgcctgcggaaaagatgcggcgccctgagtgaaaagttagttttcctgtaacccggctctacattcctcttttagtattcttcttctcccttctttcaatccctcatccatcggtctctcaacaactatggctgccaagccctacgcgctatgaagaaaaagaaaagtaggcccgccttctttcccagttgcagtttatttatgattcggaaagattgatgttagtaatggcttgtagttcataacagagtgaattaagtgtaggaagcccggaattaaatatatagtaaaaagagcacaggggcgtttacatcggggtaaaaaaaaatgcctgcaccaaaactcacggagaaatttgcctcttccaagagcacacagaaaactacgaattacagttccatcgaggccaaaagcgtcaagacgtcggctgatcaggcatacatctaccaagagcctagcgctaccaagaagatactttactccatcgccacatggctgttgtacaacatcttccactgcttctttagagaaatcagaggccggggcagtttcaaggtaccgcaacagggaccggtgatctttgttgcggctccgcatgctaaccagttcgtcgaccctgtaatccttatgggcgaggtgaagaaatctgtcaacagacgtgtgtccttcttgattgcggagagctcattaaagcaaccccccatagggtttttggctagtttcttcatggccataggcgtggtaaggccgcaggataatttgaaaccggcagaaggtactatccgcgtagatccaacagactacaagagagttatcggccacgacacgcatttcttgactgattgtatgccaaagggtctcatcgggttacccaaatcaatgggatttggagaaatccagtccatagaaagtgacacgagtttgaccctaagaaaagagttcaaaatggccaaaccagagattaaaactgctttactcaccggcactacttataaatatgccgctaaagtcgaccaatcttgcgtttaccatagagtttttgagcatttggcccataacaactgcattgggatctttcctgaaggtgggtcccacgacagaacaaacttgttgcccctgaaagcaggtgtggcgattatggctcttggttgcatggataagcatcctgacgtcaatgttaagattgttccctgcggtatgaattatttccatccacataagttcaggtcgagagcggttgttgaattcggtgaccccattgaaataccgaaggaactagtcgccaagtaccacaacccggaaacgaacagagatgcagtgaaagaattattagataccatatcgaagggtttacaatccgttaccgttacatgttctgattatgaaactttgatggtggttcaaacgataagaagactatatatgacacaatttagcaccaagttaccgttgcccttgattgtggaaatgaacagaagaatggtcaaaggttacgaattctatagaaacgatcctaaaatagcggacttgaccaaagatataatggcatataatgccgccttgagacactataatcttcctgatcaccttgtggaggaggcaaaggtaaatttcgcaaaaaacctcggacttgttttttttagatccatcgggctctgcatcctcttttcgttagccatgccaggtatcattatgttctcacctgtcttcatattagccaagagaatttctcaagaaaaggcccgtaccgctttgtccaagtctacagttaaaataaaggctaacgatgtcattgccacgtggaaaatcttgattgggatgggatttgcgcccttgctttacatcttttggtccgttttaatcacttattacctcagacataaaccatggaataaaatatatgttttttccgggtcttacatctcgtgtgttatagtcacgtattccgccttaatcgtgggtgatattggtatggatggtttcaaatctttgagaccactggttttatctcttacatctccaaagggcttgcaaaagctacaaaaggatcgtagaaatctggcagaaagaataatcgaagttgtaaataactttggaagcgaattattccccgatttcgatagtgccgccctacgtgaagaattcgacgtcatcgatgaagaggaagaagatcgaaaaacctcagaattgaatcgcaggaaaatgctaagaaaacagaaaataaaaagacaagaaaaagattcgtcatcacctatcatcagccaacgtgacaaccacgatgcctatgaacaccataaccaagattccgatggcgtctcattggtcaatagtgacaattccctctctaacattccattattctcttctacttttcatcgtaagtcagagtcttccttagcttcgacatccgttgcaccttcttcttcctccgaatttgaggtagaaaacgaaatcttggaggaaaaaaatggattagcaagtaaaatcgcacaggccgtcttaaacaagagaattggtgaaaatactgccagggaagaggaagaggaagaagaagaggaagaagaagaagaggaagaagaagaagaagggaaagaaggagatgcgtagatgccatttactgacggtgaagatactagaaactaaatctttcgccgttctatttatgtaataaacccattattgctcattgggagttgtaaatattaatgctcaatgtttatgtatatccctcgcacaggggctttttatttcttgagggggggactaattgtataattgtatgttttataaaaaagtatattgctcttttacgacttttggtctggtcccctatgctactaataacattttattctcttcaaacttcaacgttcaacctgctttgccgagacggcgattagtatcctacccaactgaaccttttctttttgtttcgctttttgttatacaatgcaatttcgtctcgctgtagtctttgggtatgtcctgtcaaattcgtcactacattttcaaaagttgtcttatcctttaggaggtctcgctgttgtttcttcaatgatcttgatttactaaccaaaaagtcaatggattgacacaatgtatcgtggtattggcgtaaagattcttcatccatactagtaaaatctgccataagcaattgcggtatatgctgctcttgctcacgctcctcttccttttgaagagattttaaagtcattggtggtgtatagtcaattttgaaattatccctcaggaagagaccagtagccgtttgctcatttttctccactgcatcgcatatccttttgaacaactcatcattcaacggttcttcctccctcttcgtaccaacaccctcagagccattattatccgataatctcaaaatgtggagcaagtttctgcgtatatgagatttattccatatgaatggctgtaacacaggatctaattgtacgagttgttcataaatgacatggggtcgttcatcttcaataagtttgctcagcttgaaacagtcattctttatggtttcttcttccaggtcaaattctccctttggtagtatcttattcaagcagttatctactacagattcggaagacgtcgttaaagtagaattctggttatagaggtcattttcaactgaggcatctgaaaaattcccaaaatcatcactagaatcactttctgcatctaatgcatttgtgacaggttctatctgatctctatcgctcatttgcttgctttgaaagaggtgcctttttctatcttgctacaccttaaattctcgtttgtgatacgcctaacgttttttttttttttcagttttgatagcaattcgcgaaactttttgtaacatcttctcttctcgaaaagcgaaaatagtaaacaataacttaaagcgtattggtattaatatatttagttgtagtaaaatcatttcaccaaacacacatacatgcgctatttgtattgagaaaatgaattttgatgcggtagcagatcaacagatgactgacagaaggtattttgctctcgaagtagcagaaagcgatgatgccgacagctcattaaattcttcatccatgggaagccccgcagtggatgtaggaagaaaagtttacaaaatcacttcgcacaagggttcagcagaagatgagagtcaatccttttttacttcttcagattctccaacatccaaaacaaggcctgtaggtaaaaccatcgaaaacgatgattactatggtaaaagatcttctacaggttcatcgctcaaacaactcttcaataaaattaatattaatgataccgctcactcttcaaacaaagaaaatgtatctcagtcggtgctatcggaaaacaagctgctctctccatctaaaaggttgtcgaagcaaggtcttacaaaggtgactaactccaagtttcgtacacccttgagacctatttcaaaccaatcgactttatcaagggatgagcctgttaaagattttagatcacttaagtttcggagcggtagtgatttcaaatgctggggtgacgagaagacaagttctcatgttcattcatccagtgtgaactcagttaattcctttacttctaccacctcttcttcaaagtggaagttctggaaaaatgataacctattgtcgaggtcgctatcttccagatctgtgaatgaccaagatccgaactttgttcagccaaaaccaaccaattcgttacaaaagaagtcttcaatttcaagttttcacaattctatttttggtggtggcaaacacacagagaagaagaggaattctggatttattatgcccgatcatcagagcacgaaggagctaaaccacaaacattcatcatcgaacctttcctttagaagtttgaagcataaaacatcacattcttcactaaataagctcaaagtaaggcgtaaaggaaatacacaagaactgaatcatccgatcaaaaaaacttgccaaatatcattgcctgttccagaccaagtctcaaaggacaagattcaactgaaattgaaaaattcaacatcattggcatccttatcttcagaagtcactcccataaacactttggactacaatgattcaattttgcaacaaatattacaactttgtgatgttaagtatatattacatgatctacgtgaagctcagtcattaggcttgtttacgttgaatactagatcggttcagctgtctcataacttttggcaaacttatcatagcgatatgcaaacttcactcatttgcaagaaagtatgtctaggggctctaagtgatttgactacttcaaacttgatatccttacatgaattgaaatcattacggttaatacaaggaactagcggtgtcgccaatttactgcaagcttatgttgtgccctcaaatcaatgtgaaaatgaccaaaacttgatactgtacttatttttcaaataccagggaactcctctatcaaggtgctctaacattgattactctcaagcattgtctattttctggcagtgcagcagtattttatatgttgctgaatccaaatttcagctcgaacacaggaatctaactttggaccatattttgatagactctaaagggaatgttactttaattgatatgaagtgctgtcgtttcttgaatatagacaacaataaggcttcctatacaagattagaccatcattatttcttccaaggccgggggactcttcaattcgagatatatgaactgatgagaagcatgctgcctcagccaatatcctgggctacatttgaaccaagaacaaacctattatggttatatcacctaagtagcagcctgctaaaaatggccaaaaaagccgtagtcagcggcgctttgaaccgggaagaaaatatcttaatcgagttgacgcacttactcgatcctgctcgaaaacattccaaaacaattttcaaaaaggaacttgttataagaacttgcggtgatttgttatctttgaagggagaaataatgcagtaaagacatcgtagtaataaggtgcaagcttttgtatccttcttaatgatttgtaagcaaaaaaaaattacgtacatcaatttgtaatggaaaggaaataaatagtataatatgaacactctttctgagaacagttatctttagcttgccccacaaactgaaagcacatttttaaaatgttttacagatgaaaatgaacccttgtactgttatcctctgtaagtcgttatttttcttttgcctttttcaggttgactgctactgtaatcgtaagaatattcaaaatcaatcatctcgcatcgcaacaaaaataaaacgaagttactggtttaggtggcagaaacatataatattggcgaacattcataaaataattaaggcttaccaacgaagcataataaaattgccagtaaccaaaggtctctgataacatgaaagtggtaaagtttccatggttggctcaccgtgaagaatcgcgaaaatatgaaatatacacagtcgatgttagccacgatgggaaaaggttggccacaggcggcctagatggcaagattaggatatggtccatagattccattttgcgttgcatggaactagaatctctaactcctgagatacctcttccgcaagacttgcagatgccgttatgtagcatgagtaggcataccggctcgataacatgtgtcaaattctcaccggatggaaagtaccttgcaagtggatccgatgatcgaattttactgatatgggctcttgacgaggagcaaagctcacaacccgcctttggttctgagcatgagagagagcattggacagttcgtaaaagattggttgcacacgataacgacatacaagacatttgctgggcgccagactccagcatactagtgacagttggtttagatagatctgtcatagtctggaacggttctacatttgaaaaactgaagagatttgacgtacatcaatcacttgttaagggcgttgtttttgatcccgctaataagtattttgcgactacatctgatgatagaaccatgaagatatttagatatcacaagacgggggatatttcttttacaatagagcatataatcaccgagccattcaaagaatcacccttgactacttattttagaaggccatcgtggtctcccgatgggcaacatattgcagttccgaacgccactaatgggcccgtaagttctatggcaattgtaaatagaggaacttgggatacaaatgttagtttaattggtcatgatgcacctacagaagtcgcaaggtttaatcctagattgtttgagagaaatgcgggtgtcaagcaaaaaaaagacgatgacccagaaaatgctctagtggggcaaaacgatgataaagttcaccattttgataaaaacatcgactctgttgtggcaacagctgggcaagataaatccttagcggtctggagtacaagtagaccaaggccaatattagttgctttcgatatcgcaaataaatcaattactgatatgtcttggaatccagacggctctttattatttgttgcgtcattagactcttcaatcaccttgtttaaattcgaaaataatgaactaggcaagccaattcctttggaaaaaaatatggagcagttatataggtacggtgttgacaaggactcattagatttccctgaaagtatcaaccaactgttactcgaagatcagacaaaatcatttaagcatacaaaaatttcaacatcgaaactaggtgaaaaccacccgacacttgcaacaaattcagcttcaaatcaaaaagataacaatgatgcttctgtctctagaagtgaacatataaatatcttgattccaaagaggaaaaaggatgctatactgaataaagccgtaactcttaaaagcggtaaaaagcgtgtggcaccgacattgatatcgacttcatcatcttctcccttttctaatggaatcaaaaagcctacattggatagtaaaaggattgaaaataatgtaaaatcatccaccaagaccattaacagtaaaaatacattgctaaatgtgccagaaggcgttgaaaagaaaattagtatctcatcgttcccattgccaaggttgggcatacattctttgattatgggtacaaaagaaaggagtgcatggaaaatctcaaattcagagctggagaatgatgatgcagataatgcgggtggtaagggttcagatggtacgagcaacagtattgacgacattgcagttctctcagaggaagaaaatgactttcataggatgactttgaacgccaagctaacccaggagaagatctggagcgaagagccgacaacacgatgccttctgcagtccgatgtcataccagacacagatgttgtcgttcttgaggggggtagtttagacgatatagccgttttagaaataagaaacggtgttgagagatcaatacaatttgattctgaagcacttttagataatcctaccagaatcttaggctatcaaggaggtaaaagaaccatcgagacctttattccagaagttatcatttgtgcaataggatcaaaagattgtaagtgctggtgcctagcttcagctaatggctctatttacatactttcatacaatggacagcagagaatcccaaaaatttgcctaggacataaagttattaaaatggtaacatcaagcaaatacctccttgttctaactgaaagaggtttattttttgcatgggacttgctggatttaaaattagtactgcgaaatgtacctatattaccaattttgaacggtcagccaattcatggaaacaaggtaagaatcaacaaggttattaaatgctttcgtttggatggttctagttgtgatttgcttttagaggttggcgatcctaaaaatgtgtataaatggactaaggatctgggttgttggtcgttatataaataataagcttataccccttcctttggacaagttttttccctcataattacgtctatattttataaatatcattgtagtattcgcattgtttaagtggttaccatttgaaacgactcatacagacaagcggttacagatgaagctttctgaaggcacagatcagaagtattttaatgtcggttgtctattagtggaaccaaagtgactacacacctcctctgtctggaagaaataaattcttagggtcgactccaccatttcaactttagtataatatgacaataaaacattattgggactgagaacgattatattaaaattagtaaaatacatacataactacttataaaaaaaaaaagagaaatttgccattttcacgagtataagcacagattgtacgaaactatttcatatagcttgttttagttattatcctataaaatcttaaaatacattaatctagaatccaaacggatttgatgcagtagcattgaatatgttggcttgccttgattgttgaggtccattaccaaacccaaatccagtaggttggttctgtaatgcttgttgttgtggttgttgcatagcacccccagtgttaaaagtgttcatcatctgtggttgttgcataattccatcggtgttgaatgtgttcatcatctgtggttgttgcatagcaccaccagtattgaaagtagtcatcatttggagctcttgcataacaccaccagtattgaaggtattcatcgtttgtggttgctgttgttgaagaacgccccctgtacttaaagtattcatggctccaccagtgaactggttctggtttaatggcgcaatacctccggttttttgtaaagtcaaaccgaattgggattgcggccggaacccgccagtgttttgagcttgagagctgaacgaagtctggggaatcatggcgcctccagtattaaatgtattcaaagcaccaccagttctctgcaaaggcatcattgctccccctgtaacttgtggtaaagcattgaaggacgtttgaggcatcattgctcctccagtaatttgtggtacagcattgaaggatgtttgaggcatcatggcactccctgtattttgaggttgggtcatcattgcaccacctgttaattgctgtgaaacgccaaatgatgtttgtggaatcatagtgccgcctgttctttgtacagttggcattgagacaccagtattagctgaaattaatccattagcagttttttggacaggtaatattgaacctgttggaagttgttgttgcccctgaacattgaatgaagtttgcgggaattgcgcacctcctgtggtggcaattggtattaggccacctccagttttttgcagaggtaagacggtagctgctgcgccgaacgtagtttgtggcatcattgcgccgccagtgttagagataggaattaacccatttcctgtcttttgaacaggtaggataccaccagtaacttgcgattgcataccaaaagttgtttgtggtacaacgaagccgccggttctttgcataggcagcatatcgcccccagtaatcattggcatcatcacaaagccagtagataagggtaagatattgttgccaccggttttgaatggatccaatggagcgggagcagatgaaaccggagcagatgaaaccggagcagcaggaacagtggtgccgccagttttcacgggttccaaatcttttaggtttggttcaggtgtcgaggcagctgcctttttaggttctaaaggttgcaagtctaataaatcctgcatggaaccagtaaattctgatttcttagagagtaaattagattcagacttagaagccggtttaacagtccaagcatcatctgtctcagctgatgtggaaggagctgtttgagcaggacttgttgtttgtggcaacaattgctgaggcagtgaggtttccggacttgtagcaacgttcaatgaaccatcaggttgtgaaaacatatttccagtggcatttgtaggaattgatgcaatattttctcttccaaatttcttgtcaagatgtttcattactctaacaatatcaccttcgcgcagacccaaggttcttaacattgagttattgatgtcaggcatcatgtcttcagtaagctgttctctatcaaaatttattgtatatctttgacaattgcttacatcaacgccgcaattcaagaaaaattcgaaccaatcatatttgttactggagttgttgttattgctgctttcggctggtggtacggacgtcgtatttggaacggaggtagtagaggttggtcttggtggttttattggaggcaattccttttcttgcaaccttgatctttcttcatctaggagttctctggcttttttcaattcgtataattcacgctctttcaatctcctatcgcgttctttttcctcctgctccttcaatctccttcttctttctctttcagagtctcttgaatcagtgccacgggaactagacccatcattcgccttaaatttctctaaggagaacccagtaattttttccacatacgctaaatcttcattggatagtttatcagcggcgacagcaatcttgacaccattagccttgtgcaagtggattttccccttagcacatccaatgaattctgcatccactttgaaagtaccacttctatcaacccatagacgcgatttttttggattggggaaatctttggtcgccgaagagttttttttgtgagaggacaatgaactttttcttgaccttttaccggcagcactacctacaacatcgttttgtagttcatcatctttccaactggcattggcattggatttagatcttgatctagatctcgacctagatggagatttggtgaagtttttcttgatagacttgatgataccgcttgctgtagattcagtatgttttttgtcacgaacaggctcaataaactgtgcaggaacgagaccgcttttccctgaatcaaccagttggcacatccaccagtccttagattttttatcatctaaaatgtagactttatcgcctgattttatggttaattcgtcctgtgattcagccatgaagtcatattgaacaatacctctctttttggatttggaagccatttcgacttctctcaacccaggatcacgggaagcacctttatattcaccaataatgttcatgatctcttcacatgtggtggtattaccagtgtgtaattcaaggcttctatatggatcaacaaattccaagaacatgtgtttcttttcgttatcataagagaccaatttatcaattgaccactcatgaggagtccccttttggggtatgaagtttatcttgttgttaccgattgatagcttggccttcttctttttccttccctcgatttcggtaacgttccaagagtgatactctgtattgtattcgtgatttccaacgttgttgctgttgctgttgtaatagtaatcatcctcttcatcgtcattatcgttatcgctgtatgatagtcttgtacgagatcgaacagccgcagcggtggcatcagtagtttcggtagtagccgttggtcttgcaggcatggcaggaggagggccctcttcatcctcatctggagcttggtcttctttactttgcatcatacgagctctatcattgtgttgaggaggtggtaaaaagttggtgggtagtacggcagcagaagcaggagcggctgcaggagtagctgcaggagcttcagcggcagcgggagcctgttcctgcttggaagtggacccattctctggttcgacgtaattgcctggaatgaagccgaattcattggaaacggtagacttaaccaacagccaatcagcatctttatcatcgaatacatcaaaaacgtcattttcatgaaacgtcaattcttcatcagcattttgcacctgttcataatcataaatggctcttaccttcttcaaaacaggagcttcttcaatgtaagtggagggcactagacccaccggttcttcgctatcggaaccaatgactcttttctttactgtccaccaatcgtcaatgtctgacttctgtaagaggtacaacagatcgtcttcttggatggccagttcttctggtgtctgcggctcataggcatagacggccctatagatgcccagaaacacagtcatactctagctcttttgtatataacacactctgtcgccttggctatgttacactatcccttcttttaggattgcaatagatatacatagtatatatgcgctaaatattcgttctgttttcgtctgatgtatctcgatttcgcatgagtggaaggaagccccttttaggaatcgtatagtcactttctacgaagcaacattctacctctatcaattacatggtttaatctacgcaggcatgttctctaagttgagaccgcctatgggaacctataaatcgtgattgacaccgtttgcatattatcacttttcttttccttttagcctcgctattcctggggctctctatgtgtgattggaagggtagagacaattgtcctgcgccggcaagaaaaacatcgtgtgtctctagagcagctttgcattctaatgtgcggtggaaatggtgcgaaaagtcgacacttgacagggcttccaactgctggcgtggcacataactgcccagcagtgaatggcctacttcatactccacctgtgccgcatcggcgagcgacactttaccgcctaggtaaccatgtacagctactcttttgggcttggataccttcgctttactattctcactgccctctatgcccttgtcggtagcatgagattgttgcgtaagctgttgaagctcagtcgcactgaacactacctgggatgacttttccagcgctgaaagccctgcgagtacgtcatagtatcccatattacttccactcattctcagctattccttgttaacaccgtgctctgctgctttcaggtaaagccattatttccacgacaactgcatttcacttttcattttcttccagaacaacaggcgctgcccttgtttccgcggagctgcctcctctgccgctcggactttccgcggaataataaatgaactatcacagtgagtcttagaatgcaaatatgtagatactgttatagaatctcattaatgtatttatgtatttcctgtgtttgtgtcttcaggagccttccaaagcaaccataggtcttaggcgacaactgcatcagcagttttattaattttttcttattgcgtgaccgcaatgaaagtgaagaaatcaactagatcaaaagtttcgacagcatgtgtcaattgcagaaaaaggaaaatcaaatgcacaggtaaatatccatgtaccaactgcatttcttacgattgtacgtgtgtattcctaaaaaaacatttaccgcagaaggaggatagttcccagtctttgcctactacagctgttgctccaccctcttcccacgccaatgtagaggcttcagcagatgtacagcatctggacactgcgattaagctagataatcaatattacttcaaactgatgaacgacctgatacagactccagtctctccgagtgcgacgcatgctcctgatacttccaataatcctactaatgataataatattctctttaaagatgattccaaatatcaaaatcaactggttacgtatcaaaatattctgacaaatttgtacgctctgccgccttgtgatgacactcagctcttgattgataaaacgaagtcgcagttgaataacctgattaacagttggaatcccgaaataaactaccccaagctttccagtttctctcctcgcccacaaagatcgatagaaacgtatcttttaaccaacaagtatagaaataaaatacacatgacgaggttctccttttggacagaccaaatggttaaatcacaaagtccagattcatttctagccaccactccactagtagatgaagtatttggtcttttctctccaatacaggctttttcactaagaggtataggatatttaattaaaaaaaatatcgaaaacacgggttcatcgatgttaatagatacaaaggaaactatttatctaatattaagattgtttgatttgtgttatgaacatttgatccaaggttgcatctctatttctaatccattagagaactatcttcaaaaaataaagcaaactcctactacgacggcatctgctagtttgcctacttccccagcacctttatctaacgatttagtcatttctgttattcatcaactacctcagccatttatacaatcgattaccgggtttacgactactcaattgatagaaaatttacatgattcattttcgatgtttcgaatagttactcaaatgtatgctcaacataggaagcgctttgcggaatttttaaaccaagctttctccttgccccatcaagaaaagagtgttttattctcgtcattctgctcatcagaatatcttctatctactctttgttacgcatactacaatgttaccctatatcacatgttggacataaacactttagattacctagagattttagtgtcattgctagaaatccaaaatgaaattgatgagcgttttggatttgaaaaaatgctagaagttgcggttacatgctccactaagatgggattgtctcgttgggagtattatgttggaatagacgaaaatactgccgaacggagaagaaaaatatggtggaaaatatacagtctggaaaagcgttttttaactgatcttggtgatttatccttaataaatgaacatcaaatgaattgtctcttgccgaaggatttcagggacatgggattcattaaccataaagaatttttaacgaaaattggtacgtcctctttatcaccgtcatcgcccaagctaaaaaacttgtcattgtccaggcttattgaatatggtgagttagcgatagcccaaattgttggagattttttttcagagactctttataatgagaaattcacgtctttagaagtatccgttaaacccacaattatcagacaaaagttattggagaaagtttttgaggacattgaatcttttaggttaaaattggccaaaataaagcttcacacctcaagagtttttcaagtagctcactgcaaatatccagaatatccaaaaaacgatctaattgaagcagctaaatttgtaagttaccataaaaatacatggttctccatcttgggtgctgttaacaatcttattgctaggctatctgaagatccagaggtgataactgagcaaagcatgaaatatgcgaatgaaatgtttcaagaatggagggaaattaatcaattcttaatacaggttgatactgattttattgtttgggcatgtttggacttttatgaactgatatttttcgtgatggcttcaaaattttatgtggaagacccgcacatcactttagaggatgttatcaacactttgaaagtttttaagagaataactaacattatttctttttttaataataatttggacgagaaggattatgattgtcaaactttcagggagttttcgagaagttcgagtttggttgccatatccataagaatcatatttttaaaatactgctatgccgaacaaattgatagagccgaattcatcgaacgtttgaaagaagttgaaccgggtctaagtgaccttttgcgtgagttttttgatacccgctcttttatttacaggtacatgttgaaatccgttgaaaaatcaggctttcatttaataattagaaaaatgttagaaagcgactataaatttttgtatagagacaaattggccactggtaatattccagaccaaggaaattcaagccaaatttctcagttgtatgacagtactgctccttcatacaacaatgcttctgcctcagcagcaaactcaccgttgaagttatcgtctttgttgaactctggagaggaatcgtacactcaagacgcatcagaaaatgttccatgtaatctgcggcatcaagatcgatcgttacaacagacaaaaagacaacattctgcgcctagccaaataagcgctaatgagaataatatatacaacttgggtactttagaggagtttgtcagcagtggtgacctgactgatttatatcatactctgtggaatgacaatacttcatatcccttcttatgaaaacgcaaaagaaatagggaagcagagcataaccatagtaaatgggacacttataactcaagaatttaattgaccccctactcatactgaggaatgtggcgtcctcgtcattatatgttcgtaagctaattgggcgaaactttagtctgtcctttctgttcggtcttcacataagatcaacgatttcttcattaattttgggcgcgctgttcaaaaaggtcctggaatgcagctgttcagtagatattatatgtaattatagcctcaacaatttttcttggatcgattggatgagctattcacccatagaggctggattttccttagtttgagaatctgcgactccttcgcgtctgacatcggtcactacgctttctctattctgctgccgttgcgttactttgataaattcatttctttttttttgtaatacagaagaatttctggtaagtttttggcctgtgcgtgttcataagggaaagacattgcgcatataggaaaatgttagaagttcaacatcgataaaatgatattgtgtagaaacaccgattcccttttgtagatttctatatctttgggtatgacttctagtattatctgtatatctaatattatagtctctaacaacagtggaattgttggaataaaaatccactatcgtctatcaactaatagttatattatcaatatattatcatatacggtgttaagatgatgacataagttatgagaagctgtcatcgaagttagaggaagctgaagtgcaaggattgataatgtaataggataatgaaacatataaaacggaatgaggaataatcgtaatattagtatgtagaaatatagattccattttgaggattcctatatccttgaggagaacttctagtgtatattctgtatacctaatattatagcctttatcaacaatggaatcccaacaattatctcaacattccccgatttttcatggtagcgcctgtgcttcggttacttctaaagaagtccaaacaactcaagatccgttagacatttcagcttccaaaacagaagaatgtgagaaggtttccactcaggctaattctcaacagccaacaacacctccctcatctgctgttccagagaaccatcatcatgcctctcctcaagctgctcaagtaccattgccacaaaatgggccgtacccacagcagcgcatgatgaatacccaacaagccaatatttctggctggccagtatacgggcacccatccttgatgccgtatccaccttatcaaatgtcacctatgtacgctccacctggggcacaatcacagtttacacaatatccacaatatgttggaacacatttgaacaccccgtcacctgagtcaggtaattcatttcctgattcatcctcagcaaagtctaatatgacatccactaatcaacatgtcagaccaccgccaatcttaacctcacctaatgactttctaaattgggttaaaatatacatcaaatttttacaaaattcgaatctcggtgatattattccgacagcaacaagaaaagccgtacgtcagatgactgatgacgaactcaccttcttatgtcacacctttcaactatttgctccatctcaattcttacccccctgggttaaagacatcttatctgttgattatacagatatcatgaaaattctttccaaaagcattaacaaaatgcagtctgatactcaagaggtaaatgacattacgaccctagcaactttgcattataatggaagtacacctgcagatgcatttgaagcagaagtcacaaacattcttgacagactaaacaacaatggcattcctatcaataacaaggtagcatgccaattcattatgagaggtctatctggcgagtacaaatttttaccgtacgcacgtcatcgatgtatacatatgacagttgctgatctgttttcagacatacattctatgtatgaagaacaacaggaatcaaaacgtaataaatctacttataggagaagtccgagtgatgagaagaaagactctcgcacctatacgaatacaaccaaacccaaatccataactcggaattcccaaaaaccaaataattcgcaatcaagaacagccagggctcataacgtatccacatttaataactctcccggccctgataacgatctcataagaggatcgactactgaaccgattcaattgaagaatacacacgaccttcaccttaggccaggaacttactgaatctacggtaaatcacactaatcattctgatgatgaactccctggacacctccttcttgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacgatctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcacatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaaaagtgcaccatcctatttcatctcatttactgatgagacaacaaaattccgttgggtttatccattacacgaccgtcgcgaggactctatcctcgatgtttttactacgatactagcttttattaaaaaccagtttcaggccagtgtcttggttatacaaatggaccgtggttctgagtatactaacagaactctccataaattccttgaaaaaaatggtataactccatgctatacaaccacagcggattcccgagcacatggagtcgctgaacggctaaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcaatcgttcattgcgtcaaatgagatccaacaatccaatgatcttaacatagaatcagaccatgactttcaatctgatattgaactatatcctgagcaaccgagaaatgtcctttcaaaagctgtgagtccaaccgattccacacccccgtcaactcatactgaagattcgaaacgtgtttctaaaaccaatattcgcgcacccagagaagttgaccccaacatatctgaatctaatattcttccatctaagaagagatctagcaccccccaaatttccgatatcgagagtaccgattcgggtggtatgcatagattagatgttcctttacttgctcccatgtcccaatctaacacacatgagtcgtcgtacgccagtaaatctaaagatttcagacactcagactcgtacagtgacaatgagactaatcatacaaacgtaccaatatccagtacgggtggtaccaataataaaactgttccgcagacaagcgaacaggagactgagaaaaggattatacaccgttcaccttcgatcgatacttcctcatcagaaagtaattcactacaccacgtcgttcctatcaaaacgtcagatacctgtcctaaggagaatacagaggaatctataattgctgatcttccacttcccgatctgcctccagaacctcctaccgaattatcagactcctttaaggaacttccaccgatcaattctcgtcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacgaacaaccttacgatacgatgaggcaatcacctataataaagatattaaagaaaaagaaaaatatatcgaggcataccacaaagaagtcaatcaactgttgaagatgaaaacttgggacactgacaaatattatgacagaaaagaaatagaccctaaaagagtaataaattcaatgtttatcttcaacaggaaacgtgacggtactcataaagctagatttgttgcaagaggtgatattcagcatcctgacacttacgactcaggcatgcaatccaataccgtacatcactatgcattaatgacatccctgtcacttgcattagacaataactaccatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgataaaacaatgtggtatggaagaagttcgtggatggtcatgcgtatttaaaaacagtcaagtgacaatttgtttattcgtagatgatatggtattgtttagcaaaaatctaaattcaaacaaaagaattatagacaagcttaagatgcaatacgacaccaagattataaatctaggcgaaagtgatgaggaaattcaatatgacattcttggcttggaaatcaaataccaaagaggtaaatacatgaaattgggtatggaaaactcattaactgaaaaaatacccaaactaaacgtacctttgaacccaaaaggaaggaaacttagcgctccaggtcaaccaggtctatatatagaccagcaagaactagagctagaagaagatgattacaaaatgaaggtacatgaaatgcaaaagctgataggtctagcatcatatgttggatataaatttagatttgacctattatactacatcaacacacttgcacaacatatactatttccgtccaagcaagtgttagatatgacatatgaattgatacagttcatatggaatacgagagataagcaattaatatggcacaaaagcaaacctgttaagccaacaaataaattagttgttataagcgatgcctcgtatggtaaccaaccgtattataaatcacaaattggcaacatatatttacttaatggaaaagtaattggaggaaagtccaccaaggcttcattaacatgtacttcaaccacggaagcagaaatacacgcaataagtgaatctgtcccattattaaataatctaagttacctgatacaagaactcgacaagaaaccaattaccaaaggattactaaccgacagtaaatctacaatcagtataattatatccaataatgaagagaaatttagaaacagattttttggtactaaagcaatgagactgagagatgaagtatcaggaaatcatctgcacgtatgctatatcgaaaccaaaaagaatattgcagacgtaatgaccaaacctcttccgataaaaacattcaaactattaacaaacaaatggattcattagatctattacattatgggtggtatgttggaataaaaatccactatcgtctatcaactaatagttatattatcaatatattatcatatacggtgttaagatgatgacataagttatgagaagctgtcatcgaagttagaggaagctgaagtgcaaggattgataatgtaataggataatgaaacatataaaacggaatgaggaataatcgtaatattagtatgtagaaatatagattccattttgaggattcctatatccttgaggagaacttctagtatattctgtatacctaatattatagcctttatcaacaatggaatcccaacaattatctcaacattcccccatttctcaggaatcccaacagttatgacaaaatttatcagaattcccagtttcatacatgtttgatatttatagataattcataatgacggtttatttattctggtaagttatgatatcatgtaaaacgaggcaacttggccgagtggttaaggcgaaagattagaaatcttttgggctttgcccgcgcaggttcgagtcctgcagttgtcgttattttttggacagtaataagagtacgtaaagtcaatggaatacgtggtaaaagcatcacgtttatgttttattaaaagattggcatagaacttggccttcttcgtaacgacttatcacccgttaaaagtatgctatatgagttatatcggctgcagtgtatttcttcctggctcatttaaagctaatgaaatgtacctctcgcttcattttctaaggtagtgttttgaaggcgtatgtatgtaatgtcacccggacttttgtaaagaaaaaattttgagtttatgtctttccgaaaatttttaccgatgagcattgaaaagttgcattattaaatttggtagcgtaaaaaccaccgattaaacaggtagtgtaggttgtaaattaaagatcatattctttcctgtttacatccagttttacgttgttggccgtattggtatatttctagtatcagttacacatatttcattgaaagtatggctaaacaaagacaaactactaaatcgtctaagcgatatagatattcttccttcaaggctaggattgacgatttgaagattgaaccggctagaaatttggaaaaaagggtacatgattatgtcgagtcgtcgcattttctcgcttcctttgatcagtggaaagaaattaatttaagtgccaaatttacggagtttgcagcggaaattgagcatgatgttcaaacattaccccaaatactatatcatgataaaaagatttttaattctttggtttcattcattaactttcacgatgagttttctttgcaaccgcttctggacctcttggctcaattttgtcatgatttaggtccagattttcttaaattttatgaagaagctatcaaaactttaataaatctgttagacgctgctatagaatttgagtcatctaatgtttttgagtggggtttcaactgtttggcttatattttcaagtatctctcgaaatttttggttaaaaaactggtactcacatgtgatcttttaattccactattgtctcattctaaggaatatctttcaagattttcagcagaagcattatcttttttagtaagaaagtgtcctgtttctaacttgcgcgagtttgttagatcagtttttgaaaagttagagggagatgatgagcaaactaacctctacgaagggcttctgatattattcacagaatccatgacgtcaacgcaagaaactctgcattcgaaagctaaagctatcatgagcgttcttttgcatgaagctttgaccaaatcatccccggaaagatctgtttcattgctctcagatatttggatgaacattagtaagtacgcctcaatcgaaagtttacttccagtctatgaagttatgtatcaggattttaacgattctctcgatgccaccaatatcgatagaatattaaaagtattgacaacaattgtcttctcggaaagtggtagaaaaattcctgattggaataaaattactatcctaattgaaagaataatgagtcaaagtgaaaattgtgcttcgctttcacaggataaagtggctttcctatttgctttatttattcgtaacagtgacgtgaaaactttaacattattccaccaaaaactttttaactacgctttaacaaatatatctgactgtttccttgaattctttcaatttgctttaaggctaagctatgaaagagtattttcattcaatggattaaaattcctacagttatttttaaagaaaaattggcaatcacaaggaaaaaaaattgcacttttttttctagaagtagatgataagcctgaactgcagaaagtacgggaagtaaatttcccagaagaatttattttatctatcagagatttttttgtcacagcagaaattaatgattcgaatgaccttttcgaaatatattggcgagctataatttttaaatattcgaaattacagaatacagaaattattatcccattgcttgaacgtatcttttcaacttttgcatcaccagataattttacgaaagatatggtcggtacactcttaaaaatatatcgtaaagaagacgacgcttcagggaataatctattaaagactattctggataattacgaaaactataaagaaagtttaaactttttaagaggatggaacaagttagtgagtaatcttcatccttcagaaagcttaaaaggactaatgtcacactatccaagtctactccttagcttgacagataattttatgttgcctgatgggaagattcgttatgaaactttagaattaatgaagacattaatgattttgcagggtatgcaagtacctgacctcctttcttcatgtatggttatcgaggaaatacctcttacactacaaaatgccagagatttaaccattagaatcaagaatgttggtgccgaattcggaaaaaccaaaacagacaagctagtatcctctttctttctcaaatacttatttggccttcttaccgttagattctctccagtttggactggtgtttttgacactcttcctaatgtttacacaaaagatgaagccctcgtttggaaacttgtgctatcattcattaaacttcctgatgaaaatcaaaatttggattactaccagcctcttcttgaagatggtgcaaacaaagttctgtgggattcgagtgtagtgaggttaagggacactattgatacgttctcacatatttggtcaaagtattctactcaaaatacgagcattatatctactactattgaaagaagggggaacaccacctacccaattttaattagaaatcaggctctaaaagttatgctatcgattcctcaagttgctgaaaatcacttcgtcgacatcgcaccttttgtttataatgacttcaagacttacaaagatgaagaggatatggaaaatgaacgtgttattactggttcatggacagaagttgatagaaacgtgtttttaaagactttaagcaagttcaaaaatataaagaatgtttatagtgcaacagaattgcacgatcatctgatggtactgttgggtagccgtaatacagacgttcagaagcttgcgttggacgcacttcttgcatacaaaaatccaacgttgaataaatatagagataatttgaaaaatctactagatgacaccttattcaaggacgagattacgacttttttaaccgaaaatgggtcgcagtctatcaaggctgaggacgaaaaggtagtcatgccttatgtccttagaattttcttcggtcgagcacaagtccccccaactagtggacagaaaagaagccgcaaaatagctgtcatttcagttttgccaaattttaagaagccatatattaatgattttttgagtttggctagtgaaaggctggattataattatttttttgggaacagccatcaaataaatagctcaaaggctaccttgaaaactatcagacggatgactggtttcgttaacattgtaaattctactctgtctgtattaagaacaaattttcctttgcatactaattcagtgctgcagccgttgatctattcaattgctatggcatactatgtcttagatactgagagcacagaggaggtacatttaagaaagatggcaagtaatttaaggcaacaaggtctaaaatgtttaagtagtgtctttgaatttgttggaaatacatttgattggtctacttctatggaagatatttacgccgttgtagttaagcctcgtatttcacatttttcggatgaaaacttacaacaaccctcctctttactaagacttttcctttattgggcacacaatccatctctgtaccagtttttgtattacgatgaatttgcaactgccactgcattgatggacaccatatcaaaccaacacgttaaggaagctgttattggcccaataattgaagcggcggactcaattattagaaatccagtaaatgatgatcactacgtagatttggtgactctcatctgcacatcatgtctgaaaatacttccttcgctatatgtcaaactttctgactcaaactcgatttccacatttttgaatttgctagttagtatcactgagatgggatttattcaagatgatcatgttagaagtcgtttaattagttcattaatatcaatattaaaaggaaagctaaaaaaactgcaggaaaatgatacccaaaaaattttgaaaatattaaagctgatagttttcaactacaattgttcttggagtgatattgaagaactatacactaccatatcttctttgttcaaaacatttgacgagcgaaacctcagggtttccttgacagagctcttcatagaactcggtagaaaagttcctgaattagaaagtatttcgaaattggttgcggacttgaattcatactcctcatcacgtatgcatgaatatgattttcctagaattttatcaactttcaaggggttaattgaagatggttataagtcctacagtgagttagagtggttacctctgttgttcacctttttacattttatcaataataaggaagaacttgcgttaagaacaaacgcatcccacgctataatgaagtttattgacttcattaacgaaaagcctaatcttaatgaagcttcaaaatcgatttctatgctgaaggatatacttttacccaatataaggattggcctcagagactccctagaagaggtacaaagtgagtatgtatcagtgctatcatatatggtaaaaaacacgaaatatttcaccgacttcgaagatatggccattttactgtacaatggtgatgaagaagcagatttttttacaaacgttaatcatattcagcttcatcgtcgtcagagagccattaaaagactaggtgaacatgctcatcaactcaaagataacagtatatcccattatttaattccaatgatcgaacattatgtcttttcggatgatgaaagatacagaaatattggaaatgagacccaaatagccatcggagggttggcgcagcacatgagttggaatcaatacaaagctcttcttagaaggtacatttctatgttgaaaaccaagcctaaccaaatgaagcaagccgtacaattaattgttcaactttctgttccacttagagaaactcttcgtatcgtaagagatggggctgagtcgaaacttactttgagcaaatttccttccaacttagatgaacccagtaattttattaagcaagaattgtatccgactctttcgaaaattcttggcactagagatgacgaaactataattgaaagaatgcctattgcggaggcattagttaatattgttttagggctcacaaatgatgatattactaatttcctccctagtattctaacaaatatttgccaagttttgagaagtaaatccgaagaattaagagatgcagtaagagtaaccttgggtaaaatcagtattatcttgggcgctgagtatcttgtctttgtgataaaggaattaatggctacattaaaacgtggttctcaaattcatgtgttaagttacactgtccactacatattaaagagtatgcacggagtcttaaaacactccgatttggatacctcgtccagtatgattgttaagattataatggaaaatatctttgggttcgctggtgaagaaaaagactctgagaattatcatacaaaagtgaaagaaattaagagtaataaaagctatgatgctggtgaaattctcgcctcaaacatcagcctgacagaatttggaacattactctctcctgtgaaggctttgttgatggtcagaattaatctaagaaatcaaaacaaactgagtgaattattgagacgatatttgttgggtttaaatcataatagtgactctgagtcagaaagtatcctcaagttctgccatcagcttttccaggaatcagaaatgagtaattcccctcaaataccaaagaaaaaagtgaaagaccaagtagatgaaaaagaagactttttcttggtaaatttggagtcgaaatcttataccatcaactcaaacagtttgcttttgaacagcactttacaaaaatttgctttagacttacttaggaacgtaataacgagacaccgctcctttttaactgtctcgcacctagagggttttattccatttttgagagattcgttactttcggaaaatgaaggtgtggtaattagtactttacgtatcctgattacattaattaggctagatttttccgatgaatctagtgaaatcttcaaaaactgtgcgaggaaggtactaaatattatcaaggtttctccttcaacttcaagcgaattatgccaaatgggtttaaagtttctttctgcctttatacgtcacacagattcaacattaaaggatactgctttgagttatgttctagggagggtcttaccagatttaaatgaaccaagcagacaaggccttgcttttaatttcctaaaagcacttgtttcaaaacatatcatgcttccagaactctatgacattgcggatactactagggaaatcatggtcacaaaccactcaaaagaaattagggatgtatccaggagcgtttactaccaatttttaatggaatatgaccaaagtaagggtcgtttagaaaagcagttcaaatttatggtcgacaatttacagtatcctaccgagtccggccgtcagtccgtaatggaattgatcaatttgattattacaaaggctaatcctgctttactatccaaattatcatcttccttctttctggcgctagttaatgtttcttttaatgatgatgcgccaagatgccgtgagatggcttcagtattgatttccaccatgcttccaaagcttgaaaataaggaccttgaaattgttgaaaaatatatagccgcttggctaaaacaggttgataatgcatcctttttaaatcttgggttgagaacttataaggtctacttgaaaagtattgggtttgaacatactattgagctagacgagcttgccatcaagcgtataaggtacattttgagcgatacgtcggtaggatcagaacatcagtgggatttggtatactcagctttaaatacgttctcatcttatatggaagcaacagagagcgtttataaacatggtttcaaagacatatgggatggtattatcacatgtctcttgtatccgcactcatgggtccgtcaatcggcggcaaatcttgttcatcaactcatagccaataaggataagctggagatatcattaaccaatctggaaattcaaaccattgcaacaagaattcttcaccaattaggtgcgccttctattccggagaatcttgcgaacgtctcaataaaaacattagttaatatcagtatcctatggaaggagcaacgcacgccgttcataatggatgtatcaaaacaaactggagaggatctaaaatatactaccgccattgattatatggtaactcgaattggtggtattatcaggtcggatgaacatcgtatggattcttttatgtcgaagaaggcgtgtattcagttattggccttattagttcaagttctggacgaagacgaagtaattgcagaaggggaaaagatattattgccgctatatggttatttagaaacatattactcaagagcagttgatgaagaacaggaagaactacgcactctttcaaacgaatgtttaaaaatactggaagacaaattgcaagtatccgattttacaaaaatatacactgctgtcaaacagaccgtattagaaagaagaaaggaaaggagatctaaaagggcaattctggctgttaacgctccacaaatttctgctgataaaaagttgagaaagcatgcgagatcgagggaaaagagaaagcatgaaaaggatgaaaatgggtattatcaaagacgtaacaaaagaaagagagcctagctgtaatatatctttataacatgtatactaatgaataaaaaatccaagttataacgtcaaagctgtagtacgttagcatttccgtaagtaaaaccgtaaacttgatacgttttttattttctttattaatagtaatactatacactgtctttaataaaacgacgctatttataaaactgttagataaaagacataccagtcttcctcatatgacctactttaaaaccccaaatgacaagaatgtttgatttgctttgtttcttttcaactcagttcttacagttcttgagaagctttggcagtcttggcagacttctttggcaacaagttttggtgaatgtttggcaaaacaccaccttgggcgatggtaacattacccaatagcttgttcaattcatcatcatttctgatggccaattgtaaatgtcttggaataattctggtttttttgttatctctagcagcattaccagccaattctaaaatttcagcagccaaatattctaagacagcagttagatagactggagcaccagaaccaattctctgggcgtagttacctcttcttagcaatctgtgcactctaccaactgggaatgttaaaccagctttagcagatctagattgagaagctttagcagctgaaccagctttaccacctttaccaccggacattatatattaaatttgctcttgttctgtactttcctaattcttatgtaaaaagacaagaatttatgatactatttaataacaaaaaactacctaagaaaagcatcatgcagtcgaaattgaaatcgaaaagtaaaactttaacggaacatgtttgaaattctaagaaagcatacatcttcatcccttatatatagagttatgtttgatattagtagtcatgttgtaatctctggcctaagtatacgtaacgaaaatggtagcacgtcgcgtttatggcccccaggttaatgtgttctctgaaattcgcatcactttgagaaataatgggaacaccttacgcgtgagctgtgcccaccgcttcgcctaataaagcggtgttctcaaaatttctccccgttttcaggatcacgagcgccatctagttctggtaaaatcgcgcttacaagaacaaagaaaagaaacatcgcgtaatgcaacagtgagacacttgccgtcatatataaggttttggatcagtaaccgttatttgagcataacacaggtttttaaatatattattatatatcatggtatatgtgtaaaatttttttgctgactggttttgtttatttatttagctttttaaaaattttactttcttcttgttaattttttctgattgctctatactcaaaccaacaacaacttactctacaactaatgtcctctgccgccgaaaagaaaccagcttccaaagctccagctgaaaagaagccagctgccaagaaaacatcaacctccgtcgatggtaagaagagatctaaggttagaaaggagacctattcctcttatatttacaaagttttgaagcaaactcacccagacactggtatttcccagaagtctatgtctattttgaactctttcgttaacgatatctttgaaagaattgctactgaagcttctaaattggccgcttataacaagaaatccactatttctgctagagaaatccaaacagccgttagattgatcttacctggtgaattggctaaacatgccgtctccgaaggtactagggctgttaccaaatactcctcctctactcaagcctaagtcactcactaggtattgtgatttagtcatgttttctttttattagtggcattttttatatattgtaacattagggttctgttacttgtccagatatgattggaagggtctagtctatcagcctccgaaggagttgtataaatgtatatatataactttataaacaaaaaaaattgggaaagatattttgcaaacagttattattaaattgtttcttaaactctccttaaagatataccctatttaggttcactacacgagcattcattgagaaattttttttaaaacaacatcgatcttatcttgagcagtttggtgcttatcagttctagtcccaacacgaatatcagtgtgtactctaacatatcctttctcatgaccgtattcatggatttcgccaatcaaacccatcacatcatcccaaggcccttcaattgttgttcctgcactgtgtaaagtgctctttaatgggctttctctgatttttttttcaatgagtgcaacaaaatcagaaatactagcagagtcggtgccaatagggaccatacacacgtccgctaaacaaaagatcttgggcattttctaaacttgtagtttatgtgctttatagttaatgatcacgacggcaatgacaaaaactgaatatcttgatctctccttttgacgatgtcagtgaatcccggttaatgatattctgtttttcacggggtggaaaagaggggagcttgaatcatactaaaaaaggaatgtcaaagagctatataattcgaataaaaagtaaaagaaacgaaaggttttattaaagggtttggagctgttttcggactgaaagccagtaacaagcttgtgtaggagtttgtctgaaaaccatcttcatttcaaataagagagcgagtaatttttaaataatttcttttctgaactacttaaatcgctatgtaccttgcggaaattattctttaatagtttaactaaaagtaaaaagttagaaatcataaatagaaaatcaaagagacaaatctcgttgcaaaagcttgaaaaatagtgctttaccaacaggttggcaaaccagaatgctaacaaaacttaaaatcccatttcccaagaggatcaatcaatcatatttaccttgatagtataggatacaagtgtctgtgcaggcctccgataacatgtaaagtaataaaagtaggagtacttgctttcagcagaaaatgaaaaaaaggacgttcaaacagactggaaatatagctattcaactggcacctactaatatcaataataataaattaatcttgagcaaattgatcctacataaatcatgtgacttatttatttaattattattaagtaaaaaagattttctatttaaatttattaattaattttttttcttaaataattattttatgtttttgttttccgaaaaagaaaaatatttcaacaagaagtatcaatatatttcttgcaaaaaattgttcaccgagaattgacaaaaaaaccttacgtcggtgacgacgatatacagatcctatattcttcatgtatgtaatagattcccataccttcttcgcatttaagacactaatagaaatgaaagctttctattagtcattcttcctatgcactagaccacgcaaaggtgaaccggcttggtacgagaattctatcacacggtaatgatagtgttcccgatgtcaagcagtcttatacagtactacccaagagcttaagaataagcaagaagatctggcaagctacaaggtactcataacgatcttcaaagcgtaagttatgatcttatgaaaatcagacttttttgtctcaacaaactcctagtttgaagatgttactgaaatgcccttcaaacacttttacttgaaaatcatcgattactattctaaccttcacaaatgagcctttacacaacttgattaataataatatttgaccttactctaaatcgtctcaaatattactgaggcacaatctcatggttattgatagaaagaagaatataacatatatcttatttacatatgttcgtcaatattataggtaatacaattttttctcagagggtttcaaactattgaaaaatggcaatggtggactacaagcagcgagagcccttcttgcatgattattcatatatttcaatccgagcaaataacttgtgttcacccaaccaaagccttctgtagcgacgcccttaaaatcagcaccttgattaccatattccgcatcaacgcgatgcggatcagtccctcttgtcacatcatatttttctaccaccattccgttataatcaacaaatgattttgtaatcatgtacagccacctataagccaatcttgtagctacttgttgataaccatatgcagataaacctttccaggctaatatttggtgcggcgcccaaccaaaaggataatcccattgcctgatcggtctatcaatagaaataggacctcttgatttttctgtgcatgcaactagtccgccgagcatttctaactgaggaagagctttttctactgtgatttttgcttgctcttcagttgcaagaccagcccacaaactccaaaaagtcgttgcagactcataagacgttctgcatttcagtttcgtgttataatagaagaaaaaccctgaatcttcgtcccacatatacttattaatccttgttttcctcagttcagctagctcctcccagtgttcagaatcggttaccgttccatcattctcatctttatattcattaccaaaatactccttaatgacgaaagcaatatctttctcatatttatagagcaaggagtttagatcaattgtcgctaaatatgcacatacaccttcaaacctataagtcgtgtcatgtcctgactctctcacggcacgatcatgtaaaaaaaatgcatccagtttgggttctttaatcatgccttcgttataaaggtacctaagcttttccagagtaacattgtacttttcagcatacggtaataatatagtatcaaaatgatctggttcagtttccggagggataccaataccatcagaatgataacaagacagccctgtcagagaatctaacctagggctcgacatccacacctctttatattctttaatagcagctctgaacgcgcgttttaacaactgaatagcgtttggattattcttacctcctatcttttcaaatacgagcagagccatatcggttaggaatggtggctgagatctgcaaagataataactcctattagcattcaaaattttactatagtgatcaatttcgaatataaaatgctccaccatacctcttgcaacatcaaccttattactttctatgagtcccagtgccattaaatatgaatcccagccatacaattcattgaatctaccgccaggtaccgcataaggataaccaactagggacctttcaccagtagatggattaacgtgttcttccatagccagggctaacaaacccggtgtatcatttaatgatttaacatactctgctgtaatatcttttggtaagtactccacttcaagttttaaggacgggttcatttgagatgcctgaatgtaaaattcgtactgctctgggcagttatatggaacataaattcttggatttttagcgcctggcgtatctatttttgagtctctagcaatttctgcaatattataaagatcaactcttctcgttaaactcgtccaaaattgagtcgttatcaatcttgataatctatcaacagggttttcatttatacgcgcctcatccaaaaatatttggtgtcgtccgaaactttttgcaatggttagttcctgcaacaagttagaaagcatatatgttcccctaacatttacatgtttgaaaccgttggaattggccgtcccgactttaataactttgggcccagtgtcttctatggtaatttggtgattcttgtctgtgtcctcactagcgagcagctcatctaaagcgagatccacattatcaatataaaatctacggttaccttggctgctgaggaagctgtcgtcttcagaacccctccttttcagggtataatccttcattccgtttttgaagtcagaaactttattgaaaacactcatagttctggttctatttagtctatgaatttttgactgttttcttggatctgttattggtccataatagacctctgcgttggaaaacgggtcaaaatactcatgcatagaggacaaccgccggtgatgtcttctaccaccttgttgcccctcttctttcaacggccgctgctctgaaccacttgaaagtggctttatgttatcttcaccatcattaccttcggatggaggatttatttccgttacttttggtaaaaaatctaccattatttgagtatatgcaggtctccttatataccaaatgtctgatccgaacctgcgtcaaatatatttgcaaagggaaaatataaataaataaataaaattgagaaataaaggatattagttttaatggaaaacagttcctacaagcgctataacatatgaaatatacattagtcgaatattaactttgggaggtaattacaattcctatccgctttatataatttagtggaactggcacgccgctcggaaaaattggacttcaaattaccccgcgcggagatttgcattataaactctataaagatgcgtgaatttctactcatttattactaattatttgaatgttcttttgcgaactcatttatcttgctcattactctataaatatctatgccatgtggtaggaaaaaaatgcagacctttcttaattcaactttttttctttcaaatcgatggggtccccattggtttcctcgtcataatcaccttcctctaatctgtactctttgtttaaaaaggatttgtgaaacgaaaattttaataaaatccatgccatccgtataggtccaaactctggccataaacaatccagcaattcgatgcgtacgcccttactcgatgcctgccatatcaaaaagtcacttaatctggaaacgccacttgtcctaatcaataaatctaaagggggtacccccgccgtgtagagatgcgattctaacgtgctttcgtctatagcggcgcccttcttatgttgaacaattgtttctttcatggcatgcaagatttcttccctgcctgtatatggaaagcagatatttaacgtggcccttttgttgttctttgtagtttccacagcaacccgaacatcttctaatagagacttatccaacaaagagagatcgccgataattttaatgcgtaccccatacttacaggccagctctccacgttctgtgatttgtcgtatcctttcgcgcgctaaagtcatcagtgattcaacttcccgtgagctcctcttgaaattttcaattgaaaaggcaaacacggtagccgtatcgactcctgcttcataacacagttctaagattctactcatactaacaaatcctgcctcgtggccctcctttacgtccatctctttctttctagcgaatctcctgttcccatccatgatgaacccaacatgtctaggtacacagttagatgcacgcaatgtgcgcgaaaagatgttttttgtccactttaacacaaatgaatgaccaggtataccactatccgtttccataccgtcttttacctgtgtttaccctatttttactgcttaagttctattgaaacctgtcattattacgaaaatttttttttttttcattctaagcattttgttggcatcttcggaaaaagcccgagcgagggtaacagggttaggggattagaagattaaagtaagacacattataatctatagagattttctacaacacaagaagtgtgccattcagtccgaattgagtacagtgggacgatgtttcaaaggtctggcgctgctcatcacatcaaattgatttcatctcgaagatgccgctttaaatcctcctttgcagttgctttaaacgctgccagtaagttggtaactcccaagattctttggaataatcccatatcattagtctcgaaggagatgaacacattggccaaaaatatagttgccctcatcgggtctggccatccggtgctaaacaaggttactagttactattttgaaacagaaggcaaaaaagtacgtcccttgttagtgttgttgttgtcaagagcactttctgaaattcccatgacagaaagaaatcacttgaaaattgacaagtcggatgttcctgaggacccaatttactctaaacctagtcaaaatcaactatttcaacgtcctgcaagtagcatatccccactacatattcttcacggtattaaaccactaaatcccttgacaaaaggtcctgagcctttgccagaagaaacttttgacaaacaaagagggattttacccaaacagagaagattagcagagattgtagagatgatacacactgcgtctttacttcatgatgacgttattgatcattctgatacaagaagaggaaggccaagcggaaatgctgcctttaccaacaagatggccgttttggcgggtgattttctcttagggagagcaacagtgtcaatttcaagattacacaaccccgaagtcgtagaactaatgtctaatagtattgcgaatcttgtcgaaggtgagttcatgcaactgaaaaatacttccattgacgcggatatcgataccatcgaaaatggccataagctacttccggttccttctaaaaagcttgaagttaaagagcacgactttcgtgttccaagccgccaacaggggctgcaattatctcatgatcagattatagaaactgcatttgaatactacatacacaagacctatctgaagactgctgctttgatatcaaaatcttgcagatgtgctgctatattatctggggcatcacctgccgttatcgacgaatgctatgatttcggtagaaatctaggtatatgtttccaactcgtagatgatatgcttgattttactgtgtctggaaaagatttagggaagccatccggcgcggatctaaaattaggtattgctactgctccagtcttgtttgcatggaaagaagacccatctttaggtccactaatttcacgcaatttttcagagaggggtgatgttgaaaaaactattgattctgtgagactccataatggtatagcgaagacgaaaatactagcggaggaatatagggacaaggcattacaaaatctacgggattctcttcctgaatctgatgctcgttctgccctagagtttttaactaatagtatactaacaagaagaaagtaaaccttgaaatttcaaataaagggtgaagaataaagagaaaatgaagaaggtcatagtgtcgcattattctatattctatatgtaaatagtttttatatgtttttagtaaaagaagaaatatacaagcattaaggatcaggctggtggtaaaaaagctgcaaataggatagtctgtaaaggtatccagaatgccaaccagtatatgtaaaacttgactatcttatcgtcacctttcggattttccattttttttggatcagaagttttaaccaatctatcagccaaataccaaaggtgcaagggtaaaaaggaggctatacgattcagaatttggacatgggcaaaaaagcatactatgacgaccagtgctctggtgatccatacgagagccttcaagttataggagggataaattttgctgaaatatatggaggaatagattaaaataataatatttgggacagcaaacaaaaagtttgggatgttgtttggggtccagtatttcaataacccaactccccaataatgactctgaatgtaggaatataaagaagttttcgtgataaaaatgcttgaaaacaattgagatttacaccattcacccctttgaggacaaaatgtcttatatggtaggtaatattgttgatatagtagagcagaaaacattaatgatcctgataatagtgggaaacatattgcttttacaaacttcctgttctttgttagttcaataaggtcaaaaataaagtaaatccctaacaaaacacagtttgaacgattcaaggatgctaaggtaaagcaagccatgctgataaaggagtaaggaaaccaatatctccacgaaatatcgaattgacccaatacgggcacggaaatggtgcattcacgactccaaataccaacaaatgcaaaaaaaaaagataatggttcagaatatatgcttgttaaaaatccagcggcactcgttaagaaaaacaacagagatgtttttttagcgatagttctagcaaactgtgattgccttatattttggctgaaaattttttttgttagaaaatataaaacaatacctgacaagtaaaataaaacattttctattgcaactccaacccttaaggcatggtagatgctatcgttattacttttaataaacagcctaacgaaaaaagtccacaactgagaaaacgcgtattcatgctcaaattgaggttttccgtttttggaagttatgttcttgataaaaaaaacactgtcccatgatagtagcttattccaaaaatacttgttccaataactgttgatttcagagggagaagaacataattcgtttaataaaagtgatgttgatgtatcaaactgcctaattggagtcaaaaaaaccagtaaatactgtattgaacggaataatacaaaataaagtgtcaaccccacaatcatattttaatttagtcttattccgcctcctctctcgaagcctctcttttatgtcttttttcgatgatgaggcttactttttttttcaactaagccttgaaaaaaaaagtttgatttaaaagggattttctattttaagtatttaaatgaccgacaggaagctcatgcagaaaaggcacctgtaatagcttattgatcattccaataaataggaaagtataactcgaattaagaataaggaatgggacttatttcatacgaaaatgaggcgataaacgaggtgaaaaaggcagataaccatcacgttagcaaatttgtgactagttactatgggccatcatcgtcgtcatggcagtcaggaatatggattttgtttgtgctgtttgttgccgcagtaatccttataatactgttcacttttgtagcgaacagaaggagacgaaggatggggcgtgctcccattagaggtacggcatggttgacaccgccttcatacagacagtctcagcaacaatatactgggaccgttcagcaacggacagatgattatgttcctgagtatacagaaacagcgaacgaacatgatcttggatactatgaccagcggggcgagtttcaccccaacgataaggctgcatacgtggcccccccgccattggtacaagaatgttcatcagaatctgttaattctttagaaagacctcccgctgctgtagttcaccaagctaactctttagatacggattacggtttaacaaggcctagcaatgggcgcgttccagctgtaagtgatacggtggagcaattggaaaggcttccgggcgggactacaacgcaggaaattaacccaccggagagggcaaaggtaaatgcaaggtcatgaactgaatctttttttccggctgtcctcttacagttgagttacaatattttgccagaaatatttacatttttttacccaatctctataataattattttaattcctaatccgcttcaggcccgcggtcgttgaagtgctatagtttatattcagtacattgtctttaatctctcagtattattttatcaatagtaaatacttcaagtccatcgcacggcgtggtggtgataaagggaaaatgcgcgcgggattagcaaaggcggccaatggattaagggtgacaagatagcaccacatcacatcacatcaccatcagtaatggagaggaaatagggtataaatactcgtcagagatcaatagatattatttcgcaacgtcctttattgttctgttcttatttgatcaattaagctagaaaaccagctacattaaaagcaaattttacaaactactatttcaacatgactttgagtaagtattctaaaccaactctaaacgaccctaatttattcagagaatctggttatattgacggaaaatgggttaagggcactgacgaagtttttgaggtggtagaccctgcttccggcgaaatcatagcaagagttcccgaacaaccagtctccgtggttgaggaagcgattgatgttgcctatgaaactttcaagacgtacaagaatacaacaccaagagagagggcaaagtggctcagaaacatgtataacttaatgcttgaaaatttggatgatctggcaaccatcattactttagaaaatggtaaagctctaggggaagctaaaggagaaatcaaatacgcggcttcgtattttgagtggtacgccgaggaagcaccccgtttatatggtgctactattcaacccttgaaccctcacaacagagtattcacaattaggcaacctgttggtgtatgcggtataatttgtccatggaattttccgagcgccatgatcacgagaaaggccgccgctgctttagctgtgggctgcacagtagtcatcaagccagactctcaaacgccgctatctgctttagcaatggcatatttggctgaaaaggcaggctttcccaagggttcgtttaatgttattctttcacatgccaacacaccaaagcttggtaaaacattatgtgaatcaccaaaagtcaagaaagttacttttactggttctacaaacgtcggtaaaatcttgatgaaacaatcttcttctactttgaagaaactgtcttttgagctgggtggtaacgcccctttcatagtctttgaggatgccgatttggatcaagccttggaacaagccatggcttgtaaatttaggggtttgggtcaaacatgtgtgtgcgcaaatagactttacgttcactcatccataattgataaatttgcgaaattactcgcggagagggtcaaaaaattcgtaattggccatggtttggacccaaaaactacacatggttgtgtcattaactccagcgctattgaaaaagttgaaagacataaacaggatgccattgataagggagcaaaagttgtgcttgaaggtggacgtttaactgagttaggtcctaacttttatgctccagtaattttgtcacacgttccctcaacagctattgtttccaaggaggagacttttggtccattatgtccaatcttttcttttgatactatggaagaagttgtcggatatgctaatgatactgagtttggtttagcagcatatgtcttttctaaaaatgtcaacactttatacactgtgtctgaagctttggaaactggtatggtttcatgtaatacaggtgttttttcggattgttctataccatttggtggtgttaaagagtcaggatttggaagagaaggttcgctatatggtattgaagattacactgttttgaagaccatcacaattgggaatttgccaaacagcatttaaagcaatagtaatcgtggacgatacttagaattgaatatgattctttgtaatgattgtatatatctattgcatgtataaatactctactcctcgtatatagaaagttaagtaaatttttgaaagaaaagagttcatatatttacggagttttgaagtttttcacaagcggaataagtgataccattcataaaatatcatatctatctatctatctatttttgtgagatatatggtacgaaaataaatgcctttccttttaagcctttctgtaagcttttatgtatacaacgtttctttatctttatttcggaccttgtttcatgtacttttccttataaatccaatctgaacctaatagatttgcaccttttttatcggctatcctaaaccatgcagcagctctggcgagatcccttttctttacgtttgaagttttggaccaaattgtcccgcttaagcacattgagtctacatggcctaatagagcagctttttccaaaaatttcaaaccttttcgctcgtcgggatgatccatcccaagaccctttaaatatgccataccacattcgtacaaggcaggtgctgttggttcaggcgctatatcagggatatcgtccattgaagcaaaatttaacggatttatatctaaatcaagaacctcagcagcaaaggatttgatatcagtggcagccattaaatatcctaatgataatttcaagttcttgtccactccgcagccatgtcgcagggctagtccatataacagaaacgcagttttgtttccgcacgcgcaggcttttttcagtcgttgtgcagattcttcaagtttgccttgatgacgcatagtaattgcctgtccgatgtgtgaagattcatcattatcataaggttctgggtgaaatttaagcttcccgcacttgcttgttgcgttcgatccttcttttttatgactgaaggaatccatgcattgcgtcgaattattgggcaacataccatctaaagaaagtgttcttcttctaactttcgggtggtagggcttatttgattgttctgttagtgcacttagttcacctatttttgaatctttttccgttgtatggaaatccgagaaagttctcaaatgagtcctatttggacgtgctttactgttcttttttttatccgtggatgactgaggtgttgatgctgttttaaaatggaaaactgggtttggaggaaaaatatacctagctaaatgtggactggaattattaatggtacttgaagtagatggaagttgaatattctccccagagaagtccaatgaattggtggcagaccggatagggcttgatccttcagactcaaggtctttcttattttttgctcttgtcctaggagatttaaaaagtttttttagcgaatttagtgacgttttttttttatgagctttatatggtggcgttggaggtaatgaaatatcatttgtcatggtatttgttttcgttatcgtcgaggtagaggaattagaccgtttaggagatggtttgatggttgttgtatcactcttagttaacttgagtttggagaatgaggatgattcactttcaaaagaagactgagttttcggctttgatagttgtccaacttcagaaaaggaggtgttggtgcttgttgaacttccgttccgataaagacaattactcttttgcgtggttgtgaactcattggggcaactctgcttctcggatattctgtcagtttttgtagatgtattaatattattactagtagttctgttattcttactattagcattattgtcaacgctagtattattgtctgatatcagcgtaggataaagatggtgcagtctagtattttcaatcctatatttctcgaagttgaaaggattaggcctatttgtgcttctattgccattttcaaggtttgggtacttataatctttctcatttctattcatttggggtttcatgccactaaaagtctcagagtcataatcttcttcgacgatataagagtatctcgacttcacgggcaaatgcctttccactttaccggaagagtatttgcctctcaaagtggaatccttttcttttaaattgtctatgataagagaacgatctctagcttgtatatatgttggagagggattagttctataccttaatgaagggaattccgacgcaggcatacataatgttggaccacttgtttgtgacagttgcgaatttctcgacgcgttttcttcttctaataaagcttcttgcagaatcagttcatcttccaagctgaggtctaatttgtcaagaagtctttccgtggtttgaatagattcgaatgaaatgctacttttatttgaatgagcatagctaaattgtgaatccattgatgactcgaagctattattgggtggtgggctttgtgaaacctctgaagagttagcttttctttcttgatcgtcgcttcctattcgatcagcccaagaagtgttttttaaattttgattcattacttttcgtgtgacgtaaaagtccgtttgtttttctagattttctgttttttctcgaggctcctacaagttccacctatatttagcattgaggaacagaatgtgctatcgcaaagagcaatggcaacagaaaaaaagagttgctaaagaagaactatttttgaatgtccgtggtaatacaatggaagactactagaacacgatggcagataaggtgatttgataatcaaattcaacgacggttgcaccgttgttctttctgccgctcttcgtccggagccttctgtgataattgttttaacgcgcagaaacacacgcaggctgcgtaaaggaatggtggggctcgaagaagtgacagtgggtgtccacggaatgttctgagcgcagggatccggtgttgccatcgcacacgatatgagacgcgttcattttttccagcagtcacctaaaagttcaagaaacgctatgttgtaatgcagctgtattgtacactggctggtattgccgttctgatctatgacttacttgttagaggtaatagctgtcttagatcggcttgcttcttctgacttccttcttttttttttttttttcgaagtgaggcatgctgcagttttgtgcagcttctcttgcatcacttcctgtattatttacgttgtttacattatcaggtattttgtattattttttgcgcaacagcaagcaaacgcaatagcgataaatgccataatataatcaaaatttagcaaggatacatagcagcaaacccgaacctttaggcctctcatagatgaagaaaatttgtacaattcttttggttctttggctcttcaaatatgaatttattaagaggaaatcctgaagcatcagaacatcgcaaactttttattcgcaagaggatttatcctctgattagttatatatgaatatgtgttccttctgcatgattttgatatcaatagtatgcattttttttcgattcgtcgtagaaacatagctactctcatgaccaaatgactctttttggctttgacagtggaacagccaagtttttatgtagaaatatattatctgttaactggaaatgatgtcttaggcccataaaatgtgctagaacgtatggctaatccttttgctctgtattcaattgagtattttgcttaatttctatttgataattgaacttcttacgtgtataaatggttgcatatttctttagtaagtactattttcaaatatgagtgaaggatattgtggctcaagtaattcctctttcttttttcatccgtatggtaagcaaagggtcacaaagtaaccgatagtgtgtagaccttagatcttccttcaaagatttcaagtctgcgataaataaacatgagaatacttgcaacaacaacttttataaacaatgaagttcattatgaacagtatttatttcactgctaaactttacgtaaacttatgtggaacatctttgtcgacagatggacgataagtaaaattgtgttattataattcaaattttcatggtaagaacatcggctttctactcctctgtgtacgaagatcttgtacgtaatgatggcccatacttataaagtataaacgggataatagctagacctaaagttaggaaccccactaaggacgaaccccatgccacaggatagttcttagtagctaaattgtcatacattgctctaccaaacaacggaaaagcacaggcaaacgaagcccgacaaaaaccattgcctgcaaaaacggatgcaacatactttgggtagcatgtagccaaatatgcaaaagttgcttggaaaatgttaaagacagctaaaacaaaaaaaacttccgagataactggcaaaatccaatgcactcgagcagtccaaccaaataagaacaaagacagaggcaggcaccagcagacacacattgccacgattaaaaaagcttccggggtgaatgtgccgtttctaaaacgtggtacaataatcctcatgtttaaaataccgaataagccataagcaagtacgcaccctacgcaaaaccccatataggccaagccaacttcaactaagctgaagtggtatatacctacaaatacaatagggaatgcttcaaagaataagtagaaacaaccataagcaacagcgatatagagatcaaaagccaaaattgcaggctctttgataatcattttgagaggcctatacaaagtattgatcaaaaaagttcttgcatcaacttctctatcgagtttatcctgttcagtatagtacctgtcatcaccagtttcttttctcaatttcaaagcacggcggtacaaaatattatggtgttgtgtttcagggaagaaaaatgccaacaagataaaagtggcagcacttaaccacattaataaccaaaatatgaatcgccaatttttagcatcgaccatagcagcgcctagtaagggagccaagactggcgcagcaacagcaccggctgaccacatacctaaaacgagaggaaccatttctggtgaaatgatatcagccactgtaccgccaccagtggccaacgatgggctgcacagtatgccactgatgaaacgcatgacgattaaaccgccgatgttatgcacagtagcacaaccaacttgaaagatcatgaaaaaaaataaagtcaccatgtacagatttagacggccatagcgtgcagtttctgatagcggtgaaaaaatgatgggacctagaccataaccaagaacatataaagaaagatttaatgttgccactacatgaccaacgtggaactcttcttgaatatattcctggccaggtgtgtaaatggaggatcccatgtacgtgacgcaagtaagtaacattatttggaatactaccaatgattttttcagtaggggccagttttgtgggttctcaggatcactggggccgttccaatccaccctgaaaggatcatttttttcgatctgtgaaccactagagtctgaatcggtagaggattcagagcacgatctattaggaccgcattctatatcatagtcgggtttacattcttttttatcggtattctcgggttttcttgtttcatcttcacgggcactctgtaaagtttctaagttggacactatacccaaatattctaaaaggtcaacaacgatagtgtgtctgtacgttgaagtgtataccatagtggagattgtcgttcaacggatactcttttataatagcttcaccataatgacaaagacggcataaggatgtagatattttagcctcgtaaagagctgtttaaatgcaattctcgtcttctttcctgttccccttttacctgactaattatcccgcccattagtcagatgattgataccaattttactcaaatgtgtactatcatgtcccttttcgcactgttattgctccttacctaagcaaatatccttttttttttctttgcatttgtcttctttcatttgaaatcttcataatcttccggaaaaactagtgatgcgcaatattgtagagaaaagcgcagggcattcctatacttagtaatcaccatcataacgtattttaaaatgaagaagcgaacctcatagaattttctatacagaagagacctttccgcgcatatacgcggtagcgtgtgtcagcatcagaggtttagcataatatattgcagaaaatgtgctagtaatatgtctctctgttgtcaatgggcttacaattgccggccatcagtatatggagtatcaatgttccttttgatcgccaacaaatactaccttttatcctgctcttcctgctctcagatattaatgccgaattgtttcatcttgtctgtgtagaagaccacacacgaaaatcctgtgatttttcattttacttatcattaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaaaatacgaggcgcgtgtaagttacagacaagcgatccctattccatgcaagttcggtaagtagcagaaataatcaaactgtttaaacccaattaaaattaaattaaataccctttatatgtttataattgtacatatttctcctaaacccgctataatacactcatatttgtagaagaaaaaccgggcagttgaatacgaatcccaaatatttgcttgttgttaccgttttcttagaattagctaaattaaccaccgaaaccgtataaggttctaccttgtctcttcaaagcataaacaacatccaaagaagtaacagtctttctcttggcgtgttcggtgtaggtaacagagtctctgatgacggattccaagaaggatttcaagacagctctgacttcttcgtagatcaaaccagaaatacgcttgacaccacctcttctagctaatcttctgatagctggcttagtaataccttggatgttatctcttagaatctttctgtgacgcttggcaccacctttacctagacctttaccacctttacctctaccggacatattttactatattatatttgttgcttgtttttgtttgttgctttagtactatagagtacaataatgcgacggaaaccatcatatagaaaaaatatctcggtatttataggaaaaagaattagaccttttccacaaccaatttatccatcaaattggtctttacccaatgaatggggaagggggggtggcaatttaccaccgtattcgcgggcatttgctaaagtaaacaacttcggtttttaccactaaccattatggggagaagcgctcggaacagttttactatgtgaagatgcgaagttttcagaacgcggtttccaaattcggcggggagatacaaaaaagatttttgctctcgttctcacattttcgcattgtcccatacattatcgttctcacaatttctcacatttccttgctctgcacctttgcgatcctggccgtaatatctctccttgacttttagcgtggaagataacgaaatgcccgggcgatttttctttttggtaccctccacggctccttgttgaaatacatatataaaagactgtgtattcttcgggatacatctctttcctcaaccttttatattctttctttctagttaataagaaaaacatctaacataaatatataaacgcaaacaatggccagaacaaagcaaacagcaagaaagtccactggtggtaaggccccaagaaagcaattagcttctaaggctgccagaaaatccgccccatctaccggtggtgttaagaagcctcacagatataagccaggtactgttgctttgagagaaatcagaagattccaaaaatctactgaactgttgatcagaaagttgcctttccaaagattggtcagagaaatcgctcaagatttcaagaccgacttgagatttcaatcttctgccatcggtgccttgcaagaatctgtcgaagcctacttagtctctttatttgaagataccaacttggctgccattcacgccaagcgtgtcactatccaaaagaaggatatcaagttggctagaagattaagaggtgaaagatcatagtttgttgattgtcatcagttttagtaaaaaacgaacaaaaacacaataaaatataaatcaatatatttaggtttactgggttctttaacagttgtataatagttattttttattacaaaaatataggttttaataaaaaaaaatagggttctatttgttttacatttattgatttgtttttcctggcgataccctcgaaaaaagccaggccttgtaggaggcaagatttatggctttccatgtggttaaagaaaaattgcagcaggaagatattcattcatgagtcagttatataatcgatatatagctacatattaaacaacttgaagccgcatacgtggtaggtgtctcattttcaattcaaaatattttaaacagaaccggagatgaagaaccacttgtcaatagacttgtcaattggagcatctgcctttggagaagctggtgggatggcatcagaggcagccttggagtaggttggggtgtcaggcaaagtaacattggtcaaatcaatacccttgctgtcagaagacttaccagcaattaattgtttccaggagtcatgtgtttccttgatgatatccaaagcgtacttcttgttcttagcttcaccggagaaggcaaattggttttctggcttaccatctgggattttgtaaattctgaaccattcgttagtagccctcaacagacctgggaagtatttctcaacatcctcaatgtcgttcaattttggggctaatggatcgttaatatcaatggcaataactttccaatcggtctcaccttcatccaataaagccatgatacctagagccttaacttgcttgacttgaccagtgtaagcaatagtttcaccaatttccaacacatcaattggatcgttgtcaccaactgccttagtttctgggtggcttacgtttgggtcttcccaagtttgtgggaaagcaccatagttgtgaatgtaaccatggtgagggaaacagtttctaacaaatctcaacttgcccttcttggtgtcttggatgattgggttcaaagtttcttccttggtgatttctaacttggcgttggtccaacgtggaatttcaacaaccatgttgaaaatgttgttttccttgtcagcgtacaagggaatgtcgtggaaggcagaaactggcttaccatccttttcgatataaactttgtattccaaggtgttcttggcaccaatttgtctggtagtgtaggtcattagtaaattgcgcggcgggatatcctgttctatagacctaagggacaacaaatcaaaatagatgattaagaaagtaagtattcaaaaacaagttgtaaatgaactaaccttcctaacttcgacgcgaccttaaaacgtcgaaaaaaaacgagaaaaagtcatcatgagactatcgtatctaatgactgtggcttctcccaacaaccttagcgtctgcgatgacgatattttgaagaacagtcaaatccgtttgaatagtgcgccacacagggataataatagcacattggcatctccttctgtgaatgaaacacttctacctgggcttcaaagtcccgcaaccttttagttacataaaattcggcggctaaatcatgatattatattgatgggtaatgtagcgttcagtaaaacggttcctatgtattactatcacgtgggtggggaagaccacattcttagagaagagtaatcattttagcagattatttttacctttttcaactcatgaactcatgttcaaaggtacaatatattaccctttcttcaaagtatccgaatgatttgaaccgcactctgagggagccatcaaattctattgagcgacttcgaatcgaacaatccaattaaatcagcctttagcgccatatttctccttgtatccattgtttacttctcccttgtatcttgtatatgagaattatgggaataagataattgttgggattccattgttttcaaaggctgtaatattaggtacacagattatactagaagttcttttcgaggatataggaatccacaaaaggaaatcgatagttatacataataatattattgtatcttacttccttttatatgttgtcactcattattgtgtcgtgcattccattagattggatgactgtttctcaatctttatgccatcctcttacaccgcatgtgatataatagtaacatgagtgctgcgaaatagatgatattaaaatttcattccaacaaagttccatatatatccatatatatatatatatttcacgaggataatgagttaaaatactatgtaaaggtattgtggttcatttttcttttatcaatttttatccaagtttttctgatctataacatgtccaatacactttttcgaactataaccgccaacaaatttatcttatagacgagaaacacttttatgatatcgatgttctacacctactgccgataacaccgtgttttcactattatagcatataccatttttgtaaccaatgtgttgttgtaattctccgcaaggcatatcccagatattcttatatggcccatttccacttcgttgaagcctcacatcaaaagagcaatcttgagataatttcaaaaccacacacatcgctgcagtttcataatatctgtcatcactgatgcaataattaagtgacgaaattatatcattattaacagctgtattattattataatcaagacaagctgaatttgatgcaaatatatattcccattcagtgccgtttctttcgaatttatagaaatcacttctttgtaggtaattgttctggcttactttgagcttattcatgttaaagtaattgttggaataaaaatccactatcgtctatcaactaatagttatattatcaatatattatcatatacggtgttaagatgatgacataagttatgagaagctgtcatcgaagttagaggaagctgaagtgcaaggattgataatgtaataggataatgaaacatataaaacggaatgaggaataatcgcaatattagtatgtagaaatatagattccattttgaggattcctatatcctcgaggagaacttctagtatattctgtatacctaatattatagcctttatcaacaatggaatcccaacaattatctaattacccacatatatctcatggtagcgcctgtgcttcggttacttctaaggaagtccacacaaatcaagatccgttagacgtttcagcttccaaaattcaagaatatgataaggcttccactaaggctaactctcaacagacaacaacacctgcttcatcagctgttccagagaacccccatcatgcctctcctcaacctgcttcagtaccacctccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtccgatcactgatgatgaactcaccttcttgtataacgcttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgtcaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatccgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcatcttaggccagaaacttactgaatctacagtaaatcatactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcattaaaggtattgcacactcctaacatagcctatgacttactcagtttgaatgaattggctgcagtagatatcacagcatgctttaccaaaaacgtcttagaacgatctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcgcatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaaaagtgcaccatcctatttcatctcatttactgatgagacaacaaaattccgttgggtttatccattacacgaccgtcgcgaggactctatcctcgatgtttttactacgatactagcttttattaaaaaccagtttcaggccagtgtcttggttatacaaatggaccgtggttctgagtatactaacagaactctccataaattccttgaaaaaaatggtataactccatgctatacaaccacagcggattcccgagcacatggagtcgctgaacggctgaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggactccagattagatcaattcaattacgacgcactcactttcgatgaagacttaaaccgtttaactgcttcatatcaatcgttcattgcgtcaaatgagatccaacaatccaatgatcttaacatagaatcagaccatgactttcaatctgatattgaactatatcctgagcaaccgagaaatgtcctttcaaaagctgtgagtccaaccgattccacacccccgtcaactcatactgaagattcgaaacgtgtttctaaaaccaatattcgcgcacccagagaagttgaccccaacatatctgaatctaatattcttccatctaagaagagatctagcaccccccaaatttccgatatcgagagtaccgattcgggtggtatgcatagattagatgttcctttacttgctcccatgtcccaatctaacacacatgagtcgtcgtacgccagtaaatctaaagatttcagacactcagactcgtacagtgacaatgagactaatcatacaaacgtaccaatatccagtacgggtggtaccaataataaaactgttccgcagacaagcgaacaggagactgagaaaaggattatacaccgcttcacctccgatcggatacttccgtcatcagaaagtaattcactacaccatgtcgttcctatcaaaacgtcagatacttgttttaaggaaaatacagaggaatctattatcgctgatcttccactccccgatctgcctccagaacctcctaccgaattatcagactcttttaaagaacttccaccgatcaattctcgtcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacgaacaaccttacgatacgatgaggcaatcacctataataaagatattaaagaaaaagaaaaatatatcgaggcataccacaaagaagtcaatcaactgttgaagatgaaaacttgggacactgacaaatattatgacagaaaagaaatagaccctaaaagagtaataaattcaatgtttatcttcaacaggaaacgtgacggtactcataaagctagatttgttgcaagaggtgatattcagcatcctgacacttacgactcaggcatgcaatccaataccgtacatcactatgcattaatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgataaaacagtgtggtatggaagaagttcgtggatggtcatgcgtatttaagaatagtcaagtaacaatttgcttattcgttgatgatatgatattgttcagcaaggacttaaattcgaataaaagaattatagcaaaactcaagatgcaatacgataccaagattataaatctaggtgaaagcgatgatgaaattcaacacgacatccttggcttagaaatcaaatatcaaagaggtaaatacatgaaattaggtatggaaaactcattaactgagaaaatacccaaattaaacgtacctttgaatccaaacggaagaaaacttggtgccccaggccaaccaggtctctatataaaccagcaagaactagagctagaagaagatgattacaaaatgaaggtacatgaaatgcaaaagctgataggtctagcatcatatgttggatataaatttagatttgacctattatactacatcaacacacttgcacaacatatactatttccgtccaagcaagtgttagatatgacatatgaattgatacagttcatatggaatacgagagataagcaattaatatggcacaaaagcaaacctgttaagccaacaaataaattagttgttataagcgatgcctcgtatggtaaccaaccgtattataaatcacaaattggcaacatatatttacttaatggaaaagtaattggaggaaagtccaccaaggcttcattaacatgtacttcaactacggaagcagaaatacacgcaataagtgaatctgtcccattattaaataatctaagttacctgatacaagaactcgacaagaaaccaattaccaaaggattactaaccgacagtaaatctacaatcagtataattatatccaataatgaagagaaatttagaaacagattttttggtactaaagcaatgagactgagagatgaagtatcaggaaatcatctgcacgtatgctatatcgaaaccaaaaagaatattgcagacgtaatgaccaaacctcttccgataaaaacattcaaactattaacaaacaaatggattcattagatctattacattatgggtggtatgttggaataaaaatccactatcgtctatcaactaatagttatattatcaatatattatcatatacggtgttaagatgatgacataagttatgagaagctgtcatcgaagttagaggaagctgaagtgcaaggattgataatgtaataggataatgaaacatataaaacggaatgaggaataatcgtaatattagtatgtagaaatatagattccatttggaggattcctatatcctcgaggagaacttctagtatattctgtatacctaatattatagcctttatcaacaatggaatcccaacaattatctaattacccacatatatctcagtaattcacagttaacaacagttgataaaaaatattctgtatacacgtccccactctgtgataaagcttcctgtttgcttgtaaattaagtgaattttcaagggcattatcaaaggccttagtaataatggtaataatatatggatacgaagaatttttcgtataatcgcatgcattattacttaacatattttcagttgaataattcattgaaagagcgtctgactcacaaaatggcgcagattttgccaaagtattattaatttgtacactattatgagagagagttaccccttcaatacccttttgcgtactattttcaagacatgcatagctacccaacagaaatgcacctaggatacatatcctgaataagggatatatcattatgaggttaagtggcctaaaacactcaattaatacggatcccttgtactattaagtcttttctatctctgaaaattaacttaagaagcgaggctatctagattagtgttgatgtatatgtgtatgctgtcctggtgtagctgtggtttttatagattatctcagatttgtgatactctgtaagtggcggcctcattttgtctctccttgaatacgaaaatttgtgggctaaagatttattctcatcaacaaatcaagtaacaatcattcgtgttggaataaaaatcaaataccgtctatcatctaacaccgtatatgataatatattgatagtataactattggttgatagacgatagttgatttttataccaacactaggaaaccacaatccaagatgagataaatatagaggaaaatacaagtttgagtttagatctgaagttaccttaacatttgtataagcaaattcgctacgcgactctcacatcaaaaactgcttctatggccaagttggtaaggcgccacactagtaatgtggagatcatcggttcaaatccgattggaagcatttttttgaatactgaaaaattaagctgatcaccaaactcatgtaatatatatgcttgactatacaaattacaggcttcttctcatatttttctgctctacgttaacctactttaaacagtccaaaaggcttatgttgtccacatgaaatgcctaaaacagatggccaatatttaatttttttccttactacatttaaatctgtatactacctaaatatcctctttcgctactgtgggagaagaagaagaataactctcagtttataatctgatctaggcactctcagattgcgaattagcttttacagtaaacgccccatcgctccattttttgaaagagtctagaagttcatcatttttatgtaactctgctatctcagtataaccacctctggaagtaccaccgatgataacgtttgggactgttctcctaccagtgactttttcaatctggtcttgtagttcttttgtgtgttcgtgcctatccaattctacaacgtagtaagatggagaaaacgtgtacgaattagtcaacaaagctttcagttttttgctatatgggcagccagtcttgctaaatacaatcatgggtgactgttccattattttgttgtattctgcagcggcatcaaattcagcgtccccactatttttatcaacttcttcggcttccttatcttgtgtatttactgtatcatggacagattggtgagtgccaggtgcatttcctgaattgtcaaacgtcaccaatgaatcaggatggtgagtagtaatactttcgttgacgctagcattcgaattccttaacacaaaaaacacaacaatgagcagtaaattagttattaccaagactctcacgtttcttttgtttataacaatagccatctctaattttcttcagttgttttgcgtttaatttgaaaattttgcttctttccaatatataggttttttcttttatttgattcgagctttttcactgaggggatatgtacacattggcaaatatcctgccgaaagtacttctttattttttttcaaaacgcagtcccacttaccggtatgacgtagtctcgattctcaaatacacccgggactgcatatttatacatctgtagtaaagtcattttatatggattgtgaaggaaaaaatttacataactggaagataaataaacataactatgtaaggaatagtaataagaatgtagaaaacgccaatggaagttgtccaaactatagtccgacccgttgcatattatttaccggcaatcgccttatcatgagtagattctaaaaatgctaatctatcggtgatgtaaccacacactcttttccattccgttttatcctgccctaaaaggtcatcgagatatttgaaaggattcttattaacacaaacatattcgtttaaaaccttgaaattctctagttcaatatcgtaattttttaccttttttaaggccgtatatgaacgagcaggtttaccattcgtagtcaaaaaattgcttttagataaatcgtatgggtcaaactttgggaagtttgaatggatgaacataacatctacatgattcttggcatttaagtcctcgttgtcgaaaaattcttcggtgtatttttcgagggaatagtttttgtcaaacttgattgcatcagctgatttagtgccaccgtatttgttgccaatgctctccatagcatttaagtaacggccataatcctgcacaaagtcgtgttgtaacattgctacaccatgaaacccgtcttcatcatggtagccttcaacgcctgtccttgttctaacttggtaaaatgatagaccataaaagtttgcagcggcaatgaaagtttccttatcaccttcaccagcagctttttgagaaaatattgggtagtaccacgttggtccattgacgttgtagaataaagatagaagagccgtagccaaatgcttcgttttgtttatcatcagttggccggattccgtagacacgtcgggtattgttccgtctaggtcacttagcgggacgtcactcaaatccttcaaatcctttgtgtaaacagcaggtggggtgatatcgtctcgagaattgcgaactctctttttcttgtccacagcaatacctgcaatgtcgtaatacaatgggtgagttgtacgcctccagaaatcgggccacatgaccaagcccgtagacacatatggttcttcattgaatatgttgtctaggggtttgatggggaagttgtcagcatccagtaagagcaggttttcaaaactagaagcgataagggccaatgatttaaactggtatcctttgaaaacaaatttttcaatcgtctctcgtggtagaatatctgaaacgtaaatacacttggagttatacttaggcagaatcttgttacaaaactcagtttcaccttcatcaccaggagggatcaggacttccacaggtaacgtggtccccatattccttaaagtcttaatgatcaaaaatgccataagggagaacttcccgccacccactgtggctataccggaccctttgtacgtaccctttggcgagacgagagtcgctatatgctctacgtagtccttatggcttttggtcagacttgctacttcatccggagatagttccaaacacttggacagctccttagcagacaacttgtaaagatctttgtagtggtcgggacggtctccaatgtcaccctttaataagcatgcctcgttatactgctttgcagtactccccttgggcgaatcaaccattagaaagttgaaaacgttgttgtagaagcttttcaacttttcattgcctgcctcatcattgtccctcaatggggttgaatcgtcagcgctggcggcgtctgaggaagatgaatacttattggagtaactctggacatatctgtctaagtactccttgtactccttgaccgacgtgttctcatccatgtatttgtttgtaatgacgaacagcccgcacaatatcaaaactatgaacgtcagcttgaacagctttgaaaaccttttggtaagcagcatactgaaaatataattttactgacctacctacactgatttgtctcgaagtagatatgataccttgagcagcacgaggatattaaaaagtagggcaattctgcttttaacgtataagcaacaccaagtacacgtaatttattttgatgattcttctatattttttttttcttcattgttattttttcactatctttttcatccctccgcaaaaggacgcgatccttttttagcacgtgaacggtaataacgggtcctggacgatgtattagagtcacctaatcaccaagcgagccaatggcgactcacttgacttgcatgtttgcataacctatttagcgaaccctccaacttctgagcgcaccagcttaacttgtgcgctaagctgccttgcccgacatagtgccatcgctcattccacctcacacctgattaactaaaagttttaaaactacgggactgcgaaaaagtagagctacgttactgcagacctacaataattgcacacatcggcctgataacgaatgcttctaaaattctactgtgctactatcggctggtcgcgcccgacgggttcgctcagccgctctgcgccctcttactcttcagccattctgctgcggccgaagctataaaagtatgtcaatttggctttttccaaaatccccctctggctctttctcttctcaagacaagcattgaagagactcactagtaagcttaagatagtcctacacacaaccaccatgtctgctaacgattactacggcggaaccgccggcgagaagagccaatattcccgtccctccaacccgccaccttcatccgctcatcagaacaaaactcaggagcgtggatacccaccccaacaacagcagcagtactaccagcagcagcagcagcatcccggatactataaccaacaaggatacaatcagcaagggtacaatcagcaagggtacaatcagcagggctacaatcagcagggatataaccagcagggatataaccaacaaggccatcaacaaccagtctacgtccaacaacaaccaccccagaggggtaacgaaggttgtctggctgcatgtctggctgcattatgtatatgctgcaccatggatatgctattctaagagaacccgcaaaagtattcaagaatgaaaaaaaaaaaaagaataatctccccttctgttctttgcagttgcctttcttcccctcagtgttattttttttcacaaggagataaaaaaaaaaactttaacatgtcactttaagcatgtatgtaatacgtctattaattatatgtaacttttataactattttcatttctatgtgatccatttgcagttatgcaccttttttttttttccgaattgtgctatgtatatatcactagtaataatgtaccaaactatacaaacacgtaggatacagtaaaaaaaattttagctggtgaactgttgtaagaaggagatttcatcgggcgtgaaatttattgcagaaatttgggcagaatggttcatcaaaaaggtgtagatctcttgcgcaaaaacattcgcctctacattgcttgaaaggcccgtaacaattttatgaatggtatcattactcattgtgacctccgtgctggtcaaattgataattttcaggaaacccatgtacgcgctactcttttcctctacatcgtccaatgcgttaacggacaaacaccatttattccagttggaatcattggcaaatgcgccagaactgaaaacttcagggtgtgttagccccatttttccgatggtcacagacaagttctccatcacagagctgtctacgatttgtgtgttggtggtaaataaatctagaatgattctagacatatcaatgatataagtattcaaatcgatacgttcgcttatcaaaccaagcgcccatatcgcatttatcacagcaggagtaccatcactatcgtcgttatgcattatttccgtaccaatcaacttcaagaaatcctccaaattaccaattaccagttccgaattgaaaaaatatacaatatctcccaacagggcaaagcagctttgtcttacttcatggacagggtcctgcaaacattctagcatgattttcaatatcgttaaatccttcgtcccttgagggaacaatagatcctgcgagtgagcgccaagaccttgtaccaatccatcaatcaaatctaatgaggtgatgatgaagtccttctcaggcactactattgtcgggtcttgatgtgatttggcttccaattcgacacaatgacatagaattctaaaggctctgttgtacacttctggtgccataggcatgaatctttcccccagtgatgatgccacgcaggaaagacattctaaaagtggccacagctccttgtcactgtctgacagcaaagcccatttttcaattaagggcggcaaaattatttgcatcgctgtctcgtctaatgcacatttttcagcaaacctgccgatggcatcatataatataattaaattctttttcttgtaatatttcaaacatttatcaaaactcgtcaataattgactataaaataaagtttcaaccaattcggagtcggcgttttcaataaatactgctacactactaatagccgcctcttgaacatcctttttcttgtccattaatgtgtttattataggttctaagactggaattaaaaactcagtatggtcttgtaatatccatggtgaaaacctacttaatgtccaacatgtcattttcctcactggtgcccacttatcgttcaattgttccactaaaaatggtattagtgctggtaagccatcattaaaatacttcattccaccttctgccatggcccccagtgctaatatagtagcttctctaataaaccacctatcagaacccaaatgttctcttaaaaatgggaacgctatatccatcacttgatgaggtaaaatattcgtcattacatctagcgttgccgcggaacattttctcaaattccattgcgtatcaacatcgccatcttcatcatcatcatcatcatcatcatcttcgttgtcatctgcatcctctccatttcctgcctctttctttttcacaatacggggtgcaatgggcttgatgtcctcatctttatcctccaagaatgcatcatcatcattagaagcttccaggagaacgatggattcttcgttatagaccattttcgataataatattggcacgatatccttaacatatggttgtaagatatgttcaggaatatttgggctcgttgcaaaggcgtgcaaaaactcgcaggcttcaatagccactttttcctcatttacagtggtgatcaaatgcaacatgaattgtacaataccatctaaatgggaaaccagcttatctggtctgaattccaataagaaactaaaactaatgcaaatctgtgccctaactaggtcgttttcgtcgttttgtgccaactgaaaaataatttctaagaatttatctaatctcacaataaaactttgtgtttgtagcgggatcactgtatttatacatttcaccgattctgagcgaatcacaggtgagaaatttggattcgaaataaacctaaaaaaactatccaataaggcttccataggcttcgtatttcccgaccattccaattggaaaaattgagcgctgtcttccatgatcttagataaagccttaatacttggctcatttccatttgaggttagctctagcaactggtaaagcatttgaagaccagttggatcatctctatgctgcctatagtaagtggaaaataaagtagtaataacgatacctgtcacgttcgaaacgagattattgttcgaattataaaggccatgtataatgtttgatttgacgtatcctaagtcgtggctattgctcttaattaaattgtttccccctagcattgaatttttcaacagcataccggcggtagctctattgttctgaagatcctgtagggagtagtgttgcttcaatacatcatcagattcgccttcaattaaaatataacacaaataattgagaaattcaggttgcagctggaagttctccatagcttccattgcgttattacgaatctctggatttggtgacatacagttctgtaaaagagttgctagttgcaacacatagtcttcggcgggcttccatgtcgatgccatctttattcacttaactactgctaacaattctgaaaaccaaagactgcggaatattctgatatgtattattactattcactgctcttctgcataattaatactgaaaagtttttcatacttttaaacataacctttttttaagcaaaactctataacccggatcagaaaactacgaaaagagggtaataacataggtgcaggatttccatcgataacgacaccgacaatgagccttgctgcaacatccaattaggactaataactatcgtaggaatttctacgtaataaacttcaacagagcctaaaatttgaaaataaataatctagaggggaaacttaaagaaattctattcttgtcaataaagtggaaatgtgtcagatgtcacagtttctttatttgtgacacatattttcaacataaattcaggcattagtgcttttataagcataagaagttgtggcgatatgaatattccagattttacttacaagctgcattgtattcctaaaattcttttttctttttttttttttttatggaaaggaccactcttacataactagaatagcattaagaatcagatttacagataatgatgtcattattaaatatatatatatatatattgtcactccgttcaagtcgacaaccaataaaaaatttaaaagaaaccaggcagttaatagaaaaaatatgatatgaatgaatattccactttctttttacagtctttgtagataatgaatctgaccatctaaatttcttagtttttcagcagcttgttccgaagttaaatctctttgaggctcacctaacaattcaaaaccaaccaagaatttccgaacagtagctgatctcagtaaaggtgggtagaaatgcatgtgaaaccaactattactcaattcatcaccagtcgcattcaaaggagcctgatggatacccattgagtatgggaaactcgtttcaaataaattatcatacttaatagttagttgctttaaaatcgaggcgaggtcctccttcaccatttggttaaattggctaattgaggcaagcttcttctttgaaatgaccaaggtctcaaatggccagatggcccagtatggaacaacaacaataaaggattcattctccactacgactcttgacttctctcttgattctaatttgacgtaatcggcaaacaaatcagtattgtgttcacgtttatatttatcaaaagatttcaattcttgcgaaacttcactagggatggattctaagcaccaagcttggccatgtggatgtaagttggaacaacccatggctgtacctttgttttcaaatatttggacatatttgaaaggcttatgattttctcttgcttctctggagagatcgtcagtcaatgcttgccaagaattaacaatatgaaccagatctgattgtttcatttgtggaatggttagattatgattggggctaaaacatatgacgaaacaattgcctctcacagattgcactttaagcagcctatttttaagattatcctcattggaatcattctgtggtaaaataggttgatcgagcctaacggcagcataatcattggggaaaatatacgttgattcatatcttgggtttaggttaccagtagctcttttgttaccaggacatagatagcattttggatcatacaatggagctgtgggcttgtaagcagcctcctgttgacctaaccaaggtcttttagctctgtgtggagaaactaagatccatgaatcggttagtggattgtaacgtctatgggaatggctagaaaaatcaaattcttcagcagtcatttttgagggaatattcaactgtttttttttatcatgttgatgctctgcataataatgcccataaatatttccgacctgcttttatatctttgctagccaaactaactgaacatagctacacattattttcagcttggctattttgtgaacactgtatagccagtccttcggatcacggtcaacagttgtccgagcgctttttggaccctttcccttatttttgggttaaggaaaatgacagaaaatatatctaatgagccttcgctcaacagtgctccgaagtatagctttccaaaaggagaggcaaagcaatttaagaatgtatgaacaaaataaaggggaaaaattaccccctctactttaccaaacgaatactaccaataatatttacaacttttccttatgattttttcactgaagcgcttcgcaatagttgtgagtgatatcaaaagtaacgaaatgaactccgcggctcgtgctatattcttgttgctaccgtccatatctttccatagattttcaatttttgatgtctccatggtggtacagagaacttgtaaacaattcggtccctacatgtgaggaaattcgctgtgacacttttatcactgaactccaaatttaaaaaatagcataaaattcgttatacagcaaatctatgtgttgcaattaagaactaaaagatatagagtgcatattttcaagaaggatagtaagctggcaaatcaggaaaatctgtagacaatcttggacccgtaagtttcaccgtttttcaaggttacacaatctttccagttctcttgattgatagcatcaatgtatctaccaggctcaattgcaaaaccttgtcttgcttcgtaaccagcagacaagaaatcaccggtataaaattgataagttggctctgtacttaaaacttctaatgtaatattggaatcgggatgaaaagccttgacaataagcgtcaattcattgtttagagtattgatttgacttggcttagcattttcatccaccacaaaacaacaatcaaactggggatttttggggcctaagaccgttggctttgtagagttaaaggtagcaatttctctatcgacgatattacccgtaggaatcatgtttttgtcgacatcaacagatttttttgaacgcaccataatctccgtaccctcaatagtgtctccatatggcttgttcagattgaaataactatgatttgttaaatttattggcgtcgcttcaccagcagtcaatttacctttatataccatttccaaacttttttgggcaacgttcacagtatactgtatggttaccaatagatcacctggaaattcggtgtccttctcattatctatcagcatgtactcggcggtaaaaacatcctttgaaggattttgaatgatgggtcccaaaaatctttttctgtggaaagaaccgatactactatgattcgcattaacgccgttattaacggttaactgatagtctttgttgcataaactaaacttacccttcgaaatacgattagcatacctgccgatcgtggcgcctatataagcactatcaggattcaaatacccttcctcattttcatagccaagaacaactgattgtccgttcactttcaggtcaacaatgctggcgcccaaattggcaaacgtggcttgaaatctggtgccggcaccaatagtcacaaatcttgcgtcataacgcatatcttcagcggaaaatctggcctcgacaccccttaactggtaaccaaaaggattctcagtagtccatttccataaatccttgcaggagtcttcaacctgcaactcggtctgccatttcagttcgcgtttggccctatctggtttagccgtcaagttcaaaacatcacctgctcttctgcccgtaactttgtatggaagatcaataccagaagctttgcagaatgcatgataaacttcaaaaactgtagaacctttaccggaacccaagttccactcacgacacaaaccttcattttcattgtaggcctctaggtattgcagggctgcaatatgaccttttgctagatcaactacgtggatataatccctgatcggggtaccatctctggaatcataatcgtctccgaagatgtaaagcttctcgcgcctaccaacagctacttgagccatatatggcaacaaattgtttggtatacctagcggatcttctccgattaatccagagggatgtgcgccaattgggttaaaataacgcaagatagcaaacttccaactttttttgtcgctattgtaaagatcattcaagatattctcaatggcgtatttcgtatgaccatacggattagtaggccctaagggacattcttctgggataggaatcatatttgggaatctcgtagcatcaccatagacagtagcagaagatgaaaaaacaaatttggaaacgttgtattgttgcattaactctaataaaacgacagttcccaaaatgttattgtgatagtatctcagcgggatttgtgtagattcacctacagcctttaaaccagcaaagtgaattaccgaatcaattttatattctttgaaaaccttttccagaccttttcggtcacacaaatcaacctcatagaagggaatgtgatgcttggtcaagacctctaacctggctacagaatcataagttgaattcgacaggttatcagcaacaacacagtcatatccattctcaattagctctaccacagtgtgtgaaccaatgtatccagcaccacctgtaaccaaaacaattttagaagtactttcactttgtaactgagctgtcatttatattgaattttcaaaaattcttactttttttttggatggacgcaaagaagtttaataatcatattacatggcattaccaccatatacatatccatatctaatcttacttatatgttgtggaaatgtaaagagccccattatcttagcctaaaaaaaccttctctttggaactttcagtaatacgcttaactgctcattgctatattgaagtacggattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactataatgactaaatctcattcagaagaagtgattgtacctgagttcaattctagcgcaaaggaattaccaagaccattggccgaaaagtgcccgagcataattaagaaatttataagcgcttatgatgctaaaccggattttgttgctagatcgcctggtagagtcaatctaattggtgaacatattgattattgtgacttctcggttttacctttagctattgattttgatatgctttgcgccgtcaaagttttgaacgagaaaaatccatccattaccttaataaatgctgatcccaaatttgctcaaaggaagttcgatttgccgttggacggttcttatgtcacaattgatccttctgtgtcggactggtctaattactttaaatgtggtctccatgttgctcactcttttctaaagaaacttgcaccggaaaggtttgccagtgctcctctggccgggctgcaagtcttctgtgagggtgatgtaccaactggcagtggattgtcttcttcggccgcattcatttgtgccgttgctttagctgttgttaaagcgaatatgggccctggttatcatatgtccaagcaaaatttaatgcgtattacggtcgttgcagaacattatgttggtgttaacaatggcggtatggatcaggctgcctctgtttgcggtgaggaagatcatgctctatacgttgagttcaaaccgcagttgaaggctactccgtttaaatttccgcaattaaaaaaccatgaaattagctttgttattgcgaacacccttgttgtatctaacaagtttgaaaccgccccaaccaactataatttaagagtggtagaagtcactacagctgcaaatgttttagctgccacgtacggtgttgttttactttctggaaaagaaggatcgagcacgaataaaggtaatctaagagatttcatgaacgtttattatgccagatatcacaacatttccacaccctggaacggcgatattgaatccggcatcgaacggttaacaaagatgctagtactagttgaagagtctctcgccaataagaaacagggctttagtgttgacgatgtcgcacaatccttgaattgttctcgcgaagaattcacaagagactacttaacaacatctccagtgagatttcaagtcttaaagctatatcagagggctaagcatgtgtattctgaatctttaagagtcttgaaggctgtgaaattaatgactacagcgagctttactgccgacgaagactttttcaagcaatttggtgccttgatgaacgagtctcaagcttcttgcgataaactttacgaatgttcttgtccagagattgacaaaatttgttccattgctttgtcaaatggatcatatggttcccgtttgaccggagctggctggggtggttgtactgttcacttggttccagggggcccaaatggcaacatagaaaaggtaaaagaagcccttgccaatgagttctacaaggtcaagtaccctaagatcactgatgctgagctagaaaatgctatcatcgtctctaaaccagcattgggcagctgtctatatgaattataagtatacttcttttttttactttgttcagaacaacttctcatttttttctactcataactttagcatcacaaaatacgcaataataacgagtagtaacacttttatagttcatacatgcttcaactacttaataaatgattgtatgataatgttttcaatgtaagagatttcgattatccacaaactttaaaacacagggacaaaattcttgatatgctttcaaccgctgcgttttggatacctattcttgacatgatatgactaccattttgttattgtacgtggggcagttgacgtcttatcatatgtcaaagtcatttgcgaagttcttggcaagttgccaactgacgagatgcagtaaaaagagattgccgtcttgaaactttttgtccttttttttttccggggactctacgagaaccctttgtcctactgattaattttgtactgaatttggacaattcagattttagtagacaagcgcgaggaggaaaagaaatgacagaaaaattccgatggacaagaagataggaaaaaaaaaaagctttcaccgatttcctagaccggaaaaaagtcgtatgacatcagaatgaaaaattttcaagttagacaaggacaaaatcaggacaaattgtaaagatataataaactatttgattcagcgccaatttgcccttttccattttccattaaatctctgttctctcttacttatatgatgattaggtatcatctgtataaaactcctttcttaatttcactctaaagcataccccatagagaagatctttcggttcgaagacattcctacgcataataagaataggagggaataatgccagacaatctatcattacatttaagcggctcttcaaaaagattgaactctcgccaacttatggaatcttccaatgagacctttgcgccaaataatgtggatttggaaaaagagtataagtcatctcagagtaatataactaccgaagtttatgaggcatcgagctttgaagaaaaagtaagctcagaaaaacctcaatacagctcattctggaagaaaatctattatgaatatgtggtcgttgacaaatcaatcttgggtgtttctattctggattcatttatgtacaaccaggacttgaagcccgtcgaaaaagaaaggcgggtttggtcctggtacaattattgttacttctggcttgctgaatgtttcaatatcaacacttggcaaattgcagctacaggtctacaactgggtctaaattggtggcagtgttggataacaatttggattgggtacggtttcgttggtgcttttgttgttttggcctctagagttggatctgcttatcatttgtcattccctatatcatctagagcatcattcggtattttcttctctttatggcccgttattaacagagtcgtcatggccatcgtttggtatagtgtccaagcttatattgcggcaactcccgtatcattaatgctgaaatctatctttggaaaagatttacaagacaaaatcccagatcactttggatcaccgaatgctactacttacgagttcatgtgtttttttatcttttgggctgccagtcttccatttttactggttccacctcacaaaattagacacctgtttactgttaaagccgtcttggttccgtttgcttcttttggtttcttaatttgggctatcagaagagctcacgggcgtattgccttaggatctttaaccgatgtacaacctcatggctctgccttttcgtgggcttttctaagatcactaatgggttgtatggctaatttctccacaatggtaatcaacgctccagatttctctagattttcaaaaaaccctaactccgctttatggtcccaattagtgtgcattccatttttgttttccatcacttgtttaattggaattctagtcaccgcagctggttatgaaatatacggtattaattactggtcgccactcgatgtgctagaaaaatttttacagactacttataataagggcacaagagctggtgttttcttaatctcttttgttttcgccgtagctcagttaggtactaatatttctgcaaactcattatcgtgtggaactgatatgtccgctattttccccaagtttatcaatatcaagcgtggttcattattttgtgcagccatggcgctgtgtatttgtccatggaatttaatggcaacatcaagtaaatttacaatggctttgtccgcatatgctatctttttgtccagtattgccggtgttgtctgctcagattactttgttgttagaagaggatatatcaagctaacacacatatattcccatcaaaagggctctttttatatgtacggaaacaggtttggtatcaattggagagctttggctgcatatctatgtggggtggctccttgcttgcccggtttcatcgcggaggtgggcgctcccgctataaaggtttctgatggagctatgaaactatattacctaagttactgggtaggatatggcttgagtttttcttcttatactgctctgtgttacttcttccctgtacctgggtgccctgttaacaacattataaaggacaagggctggttccaaagatgggccaatgtcgatgattttgaagaagagtggaaagacacaattgagagggatgacctggtagatgacaatattagtgtctacgaacacgaacacgaaaagactttcatttaagctctccatatctacatcactttctgcattaatctgaaatatttttcaaattttcatgtgtaatgatattaatccttatctatactacttacttctatttacgttctctttagcatttactttgtgcatttggccttcaatgagcattaatttcactggttttaatatattcactcactttcattcgattttttgtttgctttatggcttagcgttctttcctctctcctttctctttttacacacgagaaaaaatggataattgttgtattatgccatatgcataactttacgattcgttatgctatgcgaacttgaagcccagatttctacacgaaaagtttgagtttattagtatcttctccaagataaatatagcatcaagttacaggtatgtcgaacatcacttatgtcaaaggtaacatcttaaaaccaaagtcatatgctaggatcctcatccattcttgcaactgcaatggctcgtggggtggtgggatcgcttatcaacttgctttgcgctacccaaaagcagagaaagattacgttgaagtatgcgaaaagtatggttctaatttactaggcaaatgcatattacttcccagttacgaaaactcagatctgctgatttgttgcttgtttacatcatcatttggaggttcaagtcatggagaaaagcaaagtattttgaattatacaaaacttgctttagataaattgaagacctttagagaagcaaaagacaaaactcgaacaagtgaagattcaatcggtgactatttaaacggccacatcaaatacccaataggggaatataaattggaaatgccacagataaatagtggcatattcggagtcccttggaaagagacagaacgcgtgttagaagaatttagtggcgacatgagttttacagtatatcagctgtaattgccttagccacgtaatatgtgcctttaaagatagagaaatatttatttattaagttttagttctaaggtgtgttaaaatacctctcaaataaataagttacacacaaccatatatcaacttgtaagtatcacagtaaaaatattttcatactgtctatgcaacgaaggagtcactttcctccttccgattgagaatatcttccctttcaaattccctccatgtcctcattttaatctttgagtgatcaaattcaccttcattctcgtcttgtgcctttttattacctcccgcaatagttctcgtatcaccccatgagaagtcatcaaatttccagtacgcatatgaaggtagtacgaaattccaaataggcaaagcacaaatatatacgcacatccaccataggtacgaccatctcgtagcagttataacaacaattaagccgggcagaccaagaataattgccagtaaaactaaagtgattacgggtgtaggttttgatacaatggcaaaaataatgacataaatagtaaagcaaatggctaacggcagtaccatagtaccaatcaattcaataccaatcacaaattgcatggaaaaacagaaagtgccacataagtctctgattagaactaattcaaaaaggttatgtaccgtagaattaatccatcttcgacgctgggaaagtaagactttgaatttatcaggggcaatagttttacaagcagcttttggaacaaatacttgctttctcttagggaaagtctttaacattaatgaagataaaaatctatcttcaccaagtaataataagttcttcttatgcaaagtgtttgtaacattatccgaatatctttcaacaatatctggatttgccaatacaggtacccaataaccatctgaacctttaggagattttatacgatacattgagaaacatcccggcaaacaagttaccgaaccgaagacagattcaaaagctttagcctgatgatgcgaaatatagtactcaaacacttgaattgcagttacccaagattgtgccttattagcgatcttggtctcaccacaaagacccataatcaaaggatctttaaccatttcagcgaccatatgagttaaagcatcgggaaagactttagtatcagcatcaaccataagtaccgtttcgtagaagtctgccattagccccgtaatctgccaaatattttttaaaagctgaaattccaattgagtcattctttcatcaaatgttattttttctaaaaaggacatcagaataatttgagaatcacgcttacctctgttaccgggtttggcggccccctgctctgcaggagtaccgcacttcacaattgtaatgattgggacacgttgttgattttctggtggaattgtagaatcgtcatatttgtaaaaacccgcatatatcttggccatattgtgtcttttagagcctgatgccactgccacataggagtaaggtttaacttcatcaggtggggtgacaaagtcgtccatcattcctaacgctatctctggagtagtcttatcgttgcccgagcccttaattaaaccatcacaaacaaccatcagtagtttatgggaatttggataatctgtggtagaaagagagtctaaagtggttcttaaaccctcttcatcctcagaataacaagtaacaaaacagatagtatgaatcaatgggaacccgtatggcataaaatccagtggtggttgttgaacgatatcgggatgtataatcgtcgaatcaagactctgaatcagcgatgatcctggtacaggagaggaagtcgctttattccaaaacatcgaggatgtaggcaacaaagtagatggattacgggaatgtacagctttgttttcattcgagagtttccaagcattttgagtggtcattgttgtcattcctctgtatgaaccagaagattgtagtgaactgctcatggaggtgtctagatctatcacagattcgttaaattgaaacattttggagctgtgttttttcagcaagtcaaaggttgaagcacgcttgtgtcccaacgacttttttgagtatttctttggcctcaaatgaggatctacttcctttagaggagcttttgtttgaatattattagaccaatcctcgatatcgtttgtgtgtttatccattgttttattgtccacgatatatgcaccttgtttcctagctacagtccaacggaagtagcaggcaattatgaatttaattatcaccactgaaagaataaataccagagaaacatacaaaacgacatcagaggcaatacaaccgacggttttggagtctacttcaccaactttaataatttcgctcaaacatctcgcaatttttctttcatgcccatttgacaaaaccaacgaaagatcataaccttgtaaatttgaagtcttcaagtcatcgaatacaacgggatagtcaacgtcatccttttccaaccaatcaagaagatctaaatccaaaacgtcgccattataaacaatcaagtttctagaagagttctttataccatcccaagtgaagtaaacatcagctttcgactttaaaccgtaaaatgcgtccctatcttctttagacgtatgacagttccatcctgcgtaattttcaactgtgaagtttggcttcgaagagccatcttgattctttaacttacaaggaaaataccatgctaaattattatcatcgtcatggggaatggaagaattactctttggagttataaggttatgacagttaccattcacattttgaaacaagaacgaagcatctttaccagcatctgaccagggcccataaagggtgtctgaatctacttcaacgtcttgtataccggaacgcgaggaagtatccaattcataagccttaccgttaattacgacaaattctgttgatacttcgttgtttttcaaacgtagtttcgaactactacaaacggttttagtgaaaccaaaagtcaggaaagccacaatcgcaccaatgtacaagatgacagaaattaaagcaaccttttctctccacgccatttgtctttccttctttggcatcccgcagaaagcaagaattggagcaggtgcccaaaacgtaatgaaataacagtacatctgccaaaatgacaatgtatcattcgtttcctttcttaatggtttgatagacttatttatgggctgcgtggagctttcttcgaaattgtccacatcaccatctttatcaaattcgtcttccgcaacaccttcatcacttattttaacggaagccttcttgtcagtagtattcatatcttgtaaaagatagctatccgtttcgcggccactaaatttgcttctcactgagcctttggagcgcagggagccactccgacgagttgcatttgggtttacaccggtacttgatggtaaaacatccaggtgattcatctgctcctgcgttttctgcgcataataaaaatgtggattatcaggattgttcagtcggcttctttcgggccgcactaaagagccttgtctatgaggtgctcctgagccgacactgtgtcttgacctaagtagagactcttcatcttgattaaggttcagatagtagtcatcaggatcatctccattcaagccggtcattctaatttctttcctgcggatagtctaaacaggacctttgaagaaaatgggacctacaccaaaaatactcgagaactttgcaaatcggtaaacgtttataaccgtctaccaatgtgattcttctagcaggatttactacaagtcgaaatgttggtactgaatgtaaatctgaaacacaggaaagaatatttttgatttctatttttatgctcttattttcatttttgattttttttttcgaggtctgcgccagcgccaataacgcgttttatccaaataggcagccaaagagggtcacctatgcaggtgctgaatgcaatacaactgcgggctaactgtccatcgacgctattgaatatgcttcaagaaatatccagtctcatgcacatgtcaaatatgtgggtgagggcgcaaatacaacgcacgattatatatacatttgtggctacgtagtacgtgcggagataggcaggtatttgttcaaggatgtaaataagaactacaatgcttagttctcgaatcctagaatgtgagtaaatctcacaagcaccgcttctataaatttgtctagggtaatttgtaatcttttcccatgcggattctcttaaatacggtacagccgtcgctgctgcggtgtgattctggtttcatagatctggaaaaagaaagcgagacacaatacaagagctttgtgacacagcgtacggagagaataagataaagaacagttcctggcgtttttaattgaacttttgtactcgtctctttattctcacgaatttttttaccgccgttttcatttccattgcaaaggagggaaaatataaatgtttttatagaggcagtatatctttaatttcatagcatatgcagtttagaaaaaagacgtaaattcgttgccctagtcacgctggttacataaattggtcgttgaattgacttttaagacatccagttggtgtgtttgctccaaatagtgctgacgcatcttgccaattctcgtcaatttagcacggaatgcttgttacttattcgataacgcttttaccttgattgcatgtagtcactatcctcaaaccttttctaaggttgccctattggcgacagaaaagcaggacgagaaatctaaataaccaacgtgtggtttattaactatgacggttggtttgcttgccgccccaagttatagaagactgcccttcatcccggggtagctatcatagaatctgtcgatagttacaattttgggtggggtgttttcaaaaatggacggatatgccggtctttgaaacttcgatgatgtagcctattgttttaattttctgcttgatcctttcgctctttttagggataaaaaagaaaacctaacaaagtatgaatttcgagaagtcccatcgatagtagtcaaacaattgctaaagagggctacggatcgtctacaataccttcgtaaaacagcagcttacaggatcttttataatatcaccatagaaaggggaatttgggaagcgagagtaaaatgttgaatagttcaagaaaatatgcttgtcgttccctattcagacaagcgaacgtctcaataaaaggactcttttataatggaggcgcatatcgaagagggttttcaacgggatgttgtttgaggagtgataacaaggaaagcccaagtgcaagacaaccactagataggctacaactaggtgatgaaatcaatgaaccagagcctattagaaccaggttttttcaattttccagatggaaggccaccattgctctattgttgctaagtggtgggacgtatgcctatttatcaagaaaaagacgcttgctagaaactgaaaaggaagcagatgctaacagagcttacggttcagtagcacttggcggtcctttcaatttaacagattttaatggtaagcctttcactgaggagaatttgaagggtaagttttccattttatactttggattcagtcattgccccgacatttgtccagaagagcttgacagattaacgtattggatttctgaattagatgataaagaccatataaagatacagccattgtttatctcatgtgatcctgcaagagatacaccggatgtcttgaaagagtacttaagcgattttcacccagctatcattggtttaaccggtacgtacgaccaagtgaaaagcgtatgcaaaaaatacaaggtatatttttcaactccacgtgatgtcaagcccaaccaggattacttagtggaccattcgatatttttctatttgatcgaccctgaaggacagtttatcgatgcgttgggaagaaactacgatgagcaatctggtctcgaaaagattcgtgaacaaattcaggcgtatgtgccaaaggaagaacgggagcgtaggtcaaaaaaatggtactcttttatcttcaattgagcaaaaaaaaaaagaaaaagacacagctaggataccgaacttatgggtcgttcaatttaacagttacattgtaaatagaaaaaaatagtaaaaaaaatgaaagtcaaatgattatgcttgtcagttcaaattattaattgggcttaagggcgtaaacatgcgggaataataaacatacatacacacatacataaaatccgatgccatccactcgcgagattgcttttttcctttcgtttctctttcaagaaaatcatgttgaaaatttctatgatgatatatagtagggaactaaaccaaataaagaaaagtcaactttagtgcacgaaatcaattcttaccagcaccagctctgaagtaaatgatatcaccgtcttcaacgacatagtctttacccttttgcatcaacttaccagcggccttgatggcagaatcgtccttatattcgaagacatcttcacatttcataacttgagccaaaataaaggtattcattaaatcgttatgaataacaccagcagcttgtggagctttagtacctcttctgatggtccattcacgaacttcatctggaccgcaggtgaaaaaggaaatcaaatctaacttttgtctcatggtagtgataatctttggcaaggcagatattgtctgcagtttcttcaattcttcttcagcatcttctggggacatatgagatagtctttcttctagagaaacactgaatggaatgatcaagtcacctggagagtacttgtctacccattccttgattcttagcagatgcttgtttttctttctgatgtaatctctttcagataaattaatcaaatagatacatggcttagcagtcaacaagaacatggagttgataatttcaacttcttttgaagtccaggagtgattagcaactctttgaccactctctagcaatttaatgattttcgtaatcaaatccatttcttccttcttttgtttgacttccaaagattgaccacctcttttggcaatcttttcagcaccttccaaagccttttgtgcgaattcaatatctttcaatcttagttcttggttaataatttctaaatcacgaactggatcaacgtcaccctcaacgtggataatttcagcatcatcgaaacaacgaacgacttggtagatagaatcgactgatctgatgtgagacaagaaagcattacccaaaccttcaccagcagaggcacccttagtcaaaccagcaatatcgtaaacggtcaaatgagctggaacttccgaagctgtcttcttgtagatttcacacaacttatcaaatcttggagatgggacaataacacgggcttcttctggatcaatggtagcgaatggatagttagctgggttacccaatggacatctagtgatggcttggaaaaaggtagacttaccaacattggccaaaccgacaataccggctttcaagttattacctggacgacccaataagacctttttttcttcgacttgcttctttggaggcatgttttacagtgctatttatttgattgtttttacggatactagaagtaacacaaaaagctaaaaaaggcaaaatgcaataaaaaattagtactaattatcaactgaatacactactaaatacgatttctcgcaacgaaaggtatgagagagaagacgtaagttgactttcactgcatccttccttttgggtcataaaatcgctgggatggcccttgaaaaaattttttcagtgaaaaaaaaaagaattttcgagaaaaaaaaaaaattaggaattgtgcgtggtcattcaatacggagaattaagtaacacgcaacaactgcattctgccttagttgtctcaaggcaaattggcaccaacaatatgaacttgttgtaaagctcaactccaaagaagggaaactactcagatttgttttcttcagtttaacaggcgtatcttctgcaaatctactacgtttcctaccgaagacttcgctctacgagaattcttaggtttctacgagttacgcgcccttcttcgaacgccattctcaggaaaaattgcatttacgtaatcttttgttctaattgatataatggctatttatacgtaatatcatgcttaagaaccaagaaagccaataatggcattcggaggaagcaatcagtgaggaaaattgttgattaagctagatatttctatatctagtagatcttgtcaagttgaagtagcgaataggactcctgtattgctattgtgatgtttttttattgtacagtagttgtataacttatcgttggtattaactaccgtttgtttatacatcatgctcattatctcgtcctgactaatgtgaaaggatcgatatatacattgaagggtcgacgtccccttttattagctcctacaaagatagcactggcatatattttttaatgtcttggtatatattatatagcaactatactcgatgtcataaagaggaatactatctttggtggttgtctaactctgagcaatgctaaggcccttaccattctaaaacaaccatttttttcttccccttcccagttataccttttttgactagttctagtaactgttcgtcagtagtagtgttagtattccaggtaagagtttcaatttcatctcttggtgaaataatgtgaccataattatacattttgataaaatcactgatggtgtcaatcttgctttgggggttttttttgttcttttcagtcacccagtaccctttggatgtcaagcctttgaaaatgtgtagagatgttggtaaagttacaggttgttttgacattcctccataagtgagcatcaaagcattattttccaacttacgtgctattgatgcactggatttacctccaacagaattcaaggcaagcctcacccttgcattttcacccaaaatcttggacaatacttctttggcaaaagtcttgtcgttgttttgcgattcggaaataaccttcgtagcaccatacttatcctccaaaacttttgctacctcatcaaaattatcacggtcacgtataacacttaatgttttgatccctttagcttttgctacttgcgtaactatttttgatacactagatgtaccggcattttggataatccattcattaccgttactgttccagtcgatatagtctgatactaattggaaaccggtacaaccattaacagatacagttgccgcagaaaacagatccaaatcatttaccttgattaaatcagaactactagagaaaactctataattggaccaagtcccttgatttgcctgcaatgggataactcggtcacccaatttcaaatctcccttggaacttcccgaaggtaaagaaacaacttcaaagacaccctcattaccggcgatagcggctggctcatctgtggagtaatcgtatgtcttttctggacgagacgggtatactccttgcaactgattgatatccgaagggtttatgggaaaggccaaagtttttaacacaattgattgagataagtcttgtttaggcgtataatttttcactgacaaaaccttggtacaatcctcaacttcatgagttgaatagatgagcgatttgaagtgcttgggaatctgatgagctgaggacgacatgtaacgtttgaatgtgggaagcatcttgttatatcaaatgtaattggcagattatgaaccttcttaaatgacaatgtacgtttgtaatctccaatttctttagccatggaaacaacccctgggtacaccactcgtgcgtcccttggaggagaaccactcttttaaggtaaaaaaaaaagcaccggcggggtccaataatgataataataccataaataaggaagatggtatcaccgattggtccagaagtattatccatacagttgtttttaatattattacatacattatatattaaaaatgtgtttcgtaaccctaaagcaaaacaaagtatatacagtgacacagatcctttaaacatcaaaaaaacaaaaaaaagtaagtcagtgcagatccgagccttctctcttaatctatctaacttttaattcaaaagtacttctccaaatagctaccacttgctttataactaaatcccttgaacatatccggggacttgctcaccgaattgatattaatcggcttgctatccgtataggtttcctcatatgacatagaagtaaattctgtgtcaaaattttccgctagttccaaatccgtaataactggaacaattgggcctagagtggttttttgcaattgtccagattctaataacttccagtctatttttctaaagataaaatgttcagtgaaaagactagttcttgcagcccctgatttcttcttcttagacttagtaggcttattattagccccggttttggcccagtatttgtcaacattccaccttttggcagtttccttcttcaacagcgcgtttaatatatctttcattccctcgctcagataaaatggaattttggggccttgcttgttttgttgaatcttattaatgatcaccttatgattgctaccagtatatggaggcttacctactaacatgtcatacaacagacatcccaaagaataccaatcacaattctgactgtaagctttacctaataatatttcaggcgcacagtattcaggcgtaccgataatcgagtatagggcattgacgttctctggatcctcctcatcaaccgcggaatcattagcactttttttactcagaccaaaatctgtcaatactaaatgtccacgttgattcaataaacagttttcaggttttaaatctctatagacaacacctttcgtatgcaaaaatctcaaggcacagctgatttctgccgcgtaaaacgaaactgtcgtctcatctagggtcccgtgttccttcaagtggtaaaatagttcaccgccagggatatattgtagcagtaaatataactttgagttatcgtgaaaagaataaaataacttgacaatgtttggatgttctatttcagatagaatagaccgttcggcaaatgttctctcaagcctctttgataatccatcgtcattatcgttgttattaccatcatttttatcttcgtcttctctcttggaatctgtggctgtttgagaaattaaaatttctgctttccgtaattgcttcatagcatacagcttggatgtattgacgtccttaacaagaagaactttaccgtaggcaccttggcctaggactctcacgggcttaaaatcgtgcaggttccttgataattcattttctccaatattagaggaaataatgtcctgaggtgttatggatagtctattcgtattagttcgcattgcgtccgaacctgtaatagaaaatcttctcgtatttggtggagtgagaatagggaatttggaataagctgaggaccttcttctcatcctatgtgcaggactcatgccatttagcggaatcgcatttgaatgaaccgagaggtgatttatactctcctcatatgtgatggagctgccttgttcatgattgatatcattgtatattgccgaggaataatctactttaatgtcattctttttatcatctagtgacacacgatgaagttcttcatctagtgagaaaatcatcctaattactgccaacagtatgctcagctagattggttgatgaaaaatcttatcatagggcaccttccaggtaaaagatctacttactattagtcagtacgtccttttttcatttgtttataattttttttttttttttttttttctcctctcaatattttagaagtaacatgacagagcaacacgtttattttcctacatatagtcataagtataaaaacgagcgagaaattttgttaaagaattgatatcatattttataatttacataaactaaatagggaaagagtagtatagcgtgcataagtttgaaaaaaaaaaactattcatacactcatatatacttttatatggtcttttttatattcaagagtgattggtcaatgatttcttggtcacattaaagatgtcagccaacttttcaaaattcttcgctgatattataccttttttagataggaatctaatcaagatatcaatcaattctataatctgcttgtcgttcaggttcattaaaatagtggataaaactgtatctactgttattctgtgttcgctgatgaatgtttcatagtacaaattggcaaaagaacccattatgaattggcaatcaaccctgtctgtgataccaccatggcctgggatggagtggccaaagtctttaactttaaaagttctctttagaccagatgcgaaaaagcctccaaatggcgcaaataatgatgcaaaggtagctaagtttaaagcatggaaataaattggttttactgtaattgaattgatttgaactttatcgaaaaagatgggtggaagtctgtaaacttgtggaaggaaaactgggtttagttcacatgtcaaattagagaaaaaattggtatggagatcttcaacagggcacgtcaagtaagtataagggctcagaatccttgttaatataatactagctagagcagtgaaaaaccaggcaccaaggaaaccttctaaagttttcttgggcgagatttctattagtttagtcttaccgaatgtaatgccgcacaggtaggcgaagatatcattaacaattaccaacccgcatggtaataagaaccagaatagcccattgagcacgtttttgatgatcaaatgagcctgaaatactaccagaagaagaaccatatgagtaacgcacaatgatccgaactggaatttcaaaaatccctttcttaaactacaaacgaacagaacaaatcccataagatagagacaatagcagataaacttatgatttgttacgataaagttcaatacaggatactcgtaaaaagtagcttggaaaaacttgaagagtgatttcccatctaagtaatagatagtggtgaagagaaggtaccagttcaacgtctttgtcaatggcaaattcttttcgcgaccagatgcacttgttacggcaatacactctttaaaagtagcaatttggcagcccaaaatcagcactatacaccatgcatgacccgatgctaaggtgatgaagaaaccactgatcataacaaacgtccaaactgttctaatgaaaaagttgtatttcctgctttcctttgtagcagcagtgctttccttggtcaccggcgtgacggattcgctggcgtccttgtggagttcttcttgcaatttatcaatcgcctttgaggtggcgtcagtaaccgactccacaatctccttgctcgtaccatgtggtttcatctcagggttgtcagacattttaggtatatggaagtggaacagttaagtatgacaggttcgctgtttgggaagatacttggcaagaagtgcgtcttcacaatctggcttacactaaataacaatattgatgaatgctcccccatgctgtttacagttctcgattgttacacttttcacatgtcatcccatctgaaaaattttcaagaagggtatccgttgataatgactgtcaaatacatagcgatatagtaccaatatacagtgcctgaaaacgcctggaataagccaaagcgatcaaggtggagctcctgcagattggtttagaaagtagtgtattgatagttatttacatgggcgtttgtttatgattctttgtgcctaatatatccacgttctccgttgaattctgagatgtactgcatcaaaatagcgaaaaacgagcaataaatatcagaaaatcaaatgaagtatactcgatgaaggcagctgagatgaggtggcagatacaataagaaagatttgttgccatatataatagcaattaaaaaataaatttgaaagagtgagatgtccgtaacttttaaggacgatgttcatcggattctgaagtttgttgctaattgcaatggcaggtttgaagattccaaatgtgatataagagaatcgcctctcggtggattgggtgtctttgcaaagactgatattgcagaaggtgagtcaatattgacgttgaacaaatcctcgattttttctgcatctaacagctccattgccaatttgttatgtgacagtagcatcgatggaatgttagctctaaacatcgcattcatttacgaaactacagttttcagaaattctagtcattggtacccatttctgcgaactatccgaattcgtgatgacgaagggcacttaaacctgccgccaagcttttggcatgcggatgctaagcgacttttaaaaggaaccagtttcgataccttattcgattcgttggcaccagaagaagaaatcatggaaggatttgaaattgctgtggatttggcacacaaatggaacgacgagtttgggttggaaattccaaaaggcttcctagacgttagtgaggagaatcatgaagaagattacaatttgaaattagaaaagtttatatcggtggcatatactttatcatcaagaggatttgaaattgacgcgtaccatgagacagctttggtgcccatcgcagacctgttcaatcatcatgtttccgacccggatttaaagtttgtatcgctatatgatgtgtgcgataaatgtggtgaaccagacatgtgtaaacatctcatagcagaggaatacttggaagcagaaaatctagacaaaaatatgcccaaagtcgcaagtatggagactcgtgtcatcgatgaagacttaatcaaaagtttagaaaatgatttagagaaagaatactctaatgttacggcaaacatcgaggatgatgatggcggtattgaaaaccctgacgaatgtgtcgatttagtgttaaagaatgacgtcgcacaaggccaagaaatatttaattcctatggtgagctctcaaacgtctttttgttggccagatatggtttcaccgtacctgagaatcagtatgatattgttcatttaggacctgattttatgaaaatcttaaagaaagaagaaaaatatcaagaaaaagtcaagtggtggagccaagtcggtcatggcttgttttcagcatggtatgctcaaatgcgccaagaagatgaagaagacgaagacggtcaagcaaaatcagacaatctgtctgacgatatagagagcgaagaggaagaggaagaggaagagggtgatgatagcttggaatcatggctttcccagctttacatagactcaagtggcgagccttcaccctcaacgtgggccttagctaaccttttgactttaacggccgttcaatgggaatcattgttttccaaaaaggccactcctcacatcagtgattctatagttaacgaagaaaagctgcccttcctggccaaaaaagacaatccccattccaagaaactgctttccaacttacttaaggaaaagcaactaccttgcataaaaggcgacaactcgtcaaagataacaagtgctactaaaagcatgctccaaaatgctcgaacacttgtacaatcggagcataatatcttagatagatgtctcaagagactatcctaaataatattgaatatgcacttttactatattaatatcacgtcacacgacgcacagtgagaagtgaaaaattttttttcaatctgaaaaaaaaaaaaaaaaaaaaaaaaaatttatataaacgaatggtatctccatcacatttcttttagcctcgcaacttgtacttttcatcacttttcttgtaatttagcaatatcccaagaacaatcatcgaaatgtcccgtccacaagttactgttcactctttgactggtgaagctactgccaatgccttgccattgccagctgtcttctccgctcctatccgtccagacattgtccacactgttttcacctctgtgaacaagaacaagagacaagcttacgctgtttctgaaaaggctggtcaccaaacctccgctgaatcctggggtaccggtcgtgccgtcgctcgtattccaagagttggtggtggtggtaccggtagatccggtcaaggtgccttcggtaacatgtgtcgtggtggtcgtatgtttgctccaactaagacctggagaaagtggaacgttaaggttaaccacaacgaaaagcgttacgccactgcttctgctattgctgctactgctgttgcctctttggtcttggccagaggtcacagagtcgaaaagattccagaaatcccattggttgtctccactgacttggaatctattcaaaagaccaaggaagctgttgctgctttgaaggctgttggtgctcactccgacttgttgaaggtcttgaagtccaagaaattgagagccggtaagggtaagtacagaaacagaagatggactcaaagaagaggtccattagttgtctacgctgaagacaacggtatcgtcaaggccttgagaaacgttccaggtgttgaaactgccaacgttgcttctttgaacttgttgcaattggctccaggtgctcacttgggtagattcgttatctggaccgaagctgctttcaccaagttggaccaagtctggggttccgaaaccgttgcctcctccaaggtcggctacactttgccatcccatatcatctccacttctgatgtcaccagaattatcaactcttccgaaatccaatctgctatcagaccagctggccaagctactcaaaagcgtactcacgttttgaagaagaacccattgaagaacaagcaagtcttgttgagattgaacccttacgccaaggtctttgctgctgaaaagctaggttccaagaaggctgaaaagactggtaccaagccagctgctgttttcaccgaaactttgaaacacgattaaacttattagtacattaaaaatattcttttattttttatatacatacataagcctttaatacctttaaagcggtaacgactgcctcttgaacttaaaattattcttttttttggatatttgttcgttatgtttaatgtatatatgttgatgttcgatcagttttacgatatgctcttataggaacatttacagttttccccgcattgagtccagaccgaaggttacatacaagatttcttcagcgtttgttacttcaggaaggcaatggtaatcatacgtatcacattgagcaacctactgagggagaaaggagatttgtgcctggaactacttcgtgtagacaaaggaatatacccctttgatacttctcaaccaattggtagtatgcaggtgctgctcccccacgctagtaattaccccggttccgctcaattttatctttttgacgcggctacgaaactcggtttcgagcagtccgttaacttaaactacagtgaaaatcattggttaaacaacactccatgccagtatctgtatgtgtttttgcaacaagcacgactggagtaataaagagtcacgctagcaaaatttgtctctataagattaagattctgctttatagctttggaacctttcgtagctgtagcccgctacgtagaaatacataacaatagaataatctttcaaaaatgtcacaccatgttcctaatttatatggtacacctattcgcgaccctcacgaacgcaaacgcaattcagcgtcaatgggcgaagtaaatcagtcagtttcttcgaggaattgtgaaagaggaagtgaaaagggcacgaagcaaaggaagaaagcctctcacgcttgtgaccaatgtagaaggaaaagaatcaagtgcaggtttgataaacataccggcgtatgtcaagggtgcttagaagtcggtgaaaagtgtcaatttattagagttccattgaaacgtggtcctgcaaaaaaaaggggcagtgtagtatccattgaaaaattcagctcggataatgatcctcttcaataccgaccaagaacacattcatacccaatgaactcgggaaataactacttaccatcactcgccaggaattcctcttttccttccataagcagtctatttgttccctcgataactgctcaatcgcaacaatttgtaaaggtgccgtacgatgacatcaagcgtaggagctctctggcaatattaggcagcgattcatcgatatctaccgaatttgggggaaactatcgcttagatgaaaacttaaatgtcaggcaagaggggaaggatattgtagcgaaaggaatgataacgcccgtggaggaaatgggcgcatgttcatctaacgttcgtcgtcagggttcacaatctcttccaattcaagaacagcgcgctagcccgtacattaacccttttatctctgggagatccaggctaagcagcctttcctatacaagtgaggctacaacttcagaaggtaatacgcaaggtaaaaaccaatgcatgcttactcccaatagtgtacgttccattgaaaaggaacgattaaactcgttaactgcgggatttccgaacaaaaaattaggcacagatggtagaagtgacaaatgggacaaaaattcgacttggaagcctgtatatcgatcgtcgaatccttctcatcctagcactgaaaaaaatgtttccttgaatcaggaagccagtgctaaaccacttatgcttggaacctacagacagtttgatgcaacctcgttctacaaggttttaggcatctactataactttttccatattaattttcctgtaataccaattaacaaaagtaaatttactgacatgcttgatcctgaaaagccaaacgtgattgatgagatcagacaaattaacaatgaaattatccagtgttttaaaaccgcgctagaggtattggtattttgcaaaataaaacaaagaaggtcatcgaaatcaacaaaatcatggtctcgtgacagtttatgcgattttcaaaaaggtctgtattacattcagaatttcaacaaatgtatagccgactgcttccaaagtttaataactataaaacccgtattaaaacaaaattccagtgttattccttcaagaataaagttcatttacttttcgacaataatagtgttaaattttatcttaatattggccggtgaggaaagctcgcttttgctaggcccctctgttggggtttttaacgaatttcaagctcataagttatttctaccttttcaaaatacgtccccaatgctattattaaattcaaacgaggaaagtggtgacgagatactggattatgctgtgttgttcaaaaggttgtacatccttttaaacattctggatacgctacaaagctttcggctaggtcaaccaaaattaattaatctaaattttggtagcgccattgaaacatattttagcgataaaacaggtcataaccaagtcgtcgaaaaagctcccgtagctttggataacattctacgaaaccttaaacttggtgaatttataacatattttgtccttaacagaaaatcattgcaagtaaatgtacctcaccacttgctgttcacaaatcaaacggattacggagagttcgctgttgaaaaaggggaacatgataatatagctggcaaatttgagacccttttgaagaaaaaggaaattttaatcagaaaattactaaatattgaacagaaaaatgaccatattctagaaaattgctgcaattcggatgctgaaatgaaaaatatcggagagctagtctgctcaatgatcactctggtatcaggcatattagattcaattactaatatgaacgcagaaaactctgttgatttggattcaaagccccttccgaacgcctattttgctcaggacagtgaagaagaattaatgtcgccaacacaaagtattacgtcaaatcttgccagtgaagaaaatacacgttgcacaaccaaagacttgatgggaactgtttctattttcatgctgccaatggtggaagaatgctataatatcattagtttgataggacccatacctaccacattaataagtttatacatccgtaatggaaatatggccaagggaataaatgacagaattatgacgttgtcaactgcgctgaacgaattggtgcaaataaccgcactatttaataccctagaaccttttaggaagaatgcacatgaccgtgctaagcgttactatgtaagtgctacaagtagtaccggatgctacgaatcggtaatgaagagcatgtattccggaaaatgtgcagctagtaacgcctcaaacgttgcgccatcggaggaagaaaacaaaaagatattgaaaaagtttgccgacataggttggaaattgatggatgattcagaattgggttgttgctgttgcttctttaactaatattcatgataacaaggtgaaaaatagcatcctaatgaaggatagataagtagattttttcttttaaaaactatagtacaaggacatgcaaagtcatatatctaaactaattttggtacacgaccaacaaaaaagggtaacaaagtacacatattcgcgtcaataatatgaacaagtttgtttatttgcttttcaaatttttttctttctccagcaaacaaaagtcttaatgcattaaataagaaccttcgttttttctgcttcttgaattaccgtcgatgccattcgattcgaacttgtaagaaattttgatatttagatctctgttattcttctcgtttggagagcaaaccaattcaccttcaatggtgtcaccagtttcagcatctagatcatcagggaaataaaatattgtttgcttccagtgagtgtatggagcatgaggaccagtggagaactcaacaggtctcttaccctttggtgcagggaaaacaatgtcgaaccaggtgactataccattaatcatatcttgtctcttggccgtcaatttaaagttactcttaaacgctagatctgatatttttactgtatttaaatcaaattcgatcaatttgtctgaggtggtgttgacattgtttctttccacggtgtcgacgatgggctcgtgtaagaccaacggaacaaatggcgaataatcaaacccgtaaacgtcttgccagtagttcaacttctcgtctttatactgagagtcttccaaaccggccaaatgaatggagcacttgtcgggaaagatcagaccgccttctaccaaatagtggtctctagcgtaaagaacggtgtccatcatggactcgtatagtagaaagtaacccatccattcagaaattatgatgtcaactttaggaaagggtaaatgaacgtcctccaacttgcctcttagcaaggtgatcttgtcgctgaatccgttcaactctaccaattccttcgccatctcaataatgcttgacatatcaacaccgataacatgcttcgcaccgtgtttagcggcaaacatggataaaataccggtaccgcaaccgacgtctaaaacaatcttgtccttaaaaagatccttattttggataattgcgtttctgtaagataaggtacgaacagtatcttgaagcatctcttcgtgaataccatagtgatcgtacgaattgaagtagtgctgttcgctttcacttagcttggttttttctgtagcagaatctttcacggctgtcttgctcattattttctttggatgaatttgtcggttctaactcttttttggaaacggcaaggtgagcagtaggcagctcatctcttcaactatttttataacatataatttccctttgtgaaaaaattttcccgccatttccaaatttcggaattcctttttcttttttttcatctcggtatattctgacatattaccctataggcggtataaaaagattcattatacagtataaaatagaaaatgagagaattatatggtgttaaatagatcctacattgaatttttcattaacagtccctcatggggctagtctaacgactttccatggatcgttttctgtttttcttctgtaaacgaatctatcatgcaatctcgagggtctaccttgccagaactcaatttccagtggaacgattctcaagccaccccaataatctggacatgggatgtcttcagcatccttgaaacgttcggtgtttttttgggtcaactcgtctagttcttctctgttcttgataacatccgattggcgggaagcccatgcaccgatcttggatccacgaggtctcgtcttaaagtatctttcagaagtttctctgttaacatgctctgtgataccttcaactctcacctgcctttgcagatccttccaaaagaatacgattgccgcattcgggttggtagcaatatcatgagcctttctagaggttccccagttagaataaatagtaaaacctctatggtcgagctccttaaaaagaagaatcctggacgacaccctcccactaggtagttccgcggatgaaaaagtaattgcttctggcaacgtttcccttgggtcttccttggcttcgttgaaccatttggtgaaaagatcgattgggtcgtcagtaagttgtttttcattcaaagtaaatttatcatattgatacgtctcaggagcaaatatgattggcttttgggtctcctcagcttgtttagtcattttcagtgcagatccgtgaagtgtactactggtctaggtagagtatctttaaaatatctaatcatgcaaattagtcatttcttctttcttataagttgcggccccttctagtatttacaatttacccggcgctggttctggtggcatctataagagctctatctggctgctaagcagacttgctgttacttgtatgtgctgtttatcaagattggggcattacgcatgtgtatgtgtgaactacagtagtgttatgaaatacagcctgaaagacgaaaacttcacaacggaacttaagcggttcaataaacatctatctgccagcttagagagactacccgtggtagagaaagacacgggcagccaaaaatactgggtgttgtatatttacttgtgttagtttataaataaattttatatcactatatgtgtggtgaaaaggaagagcaatcctgctaaagcttttatatctaaacgccaaaaaaataaaaaaaaaaggaaatgggagaaaagttttcagcgcgcgaactcgcgaaaaaacttcctctttagcaatggtgacatatagatctcaaggttctcaattaaaagaccttctttgtagcttttagtgtgatttttctggtttgagaataaaactagagaggaagataggtaccctatgaaaatgtcaatggctgttgcgtttgcttaatcgtatttttttttttttcagtccgtgttttttgtacattctacgtttgagttttccatcatgcaggcctcagaaatttggtaggcactcgatggtgaagagatagtgtcggatttcggattgatctttcagttgatagcctgctgctcttttcttttccaaagaatttcgagtatgctggtgtcagtgtagatgcttgtgtgtgcgcaatttgtggttttttattgtgtttctacttatagatggctaaaatctgagtttagaaaatgcaaaccgtaaattcttaaacactgctattgcatttagttgctaaagcagtgtttttgaacttattcctgttattccttcttcgtaccgatcctcttctcgacctaaccttttaattaccatgggaagcctaccatcaccacacccacacacaaatgttacagctaattgtttattagcaaagtttgcacgagttcgctgtttatttttttctcgttttcttatacctagtattttttctgacactgtttaaggtgacagaaaaaaaggagtttaagttagatttgcaaacagacggtgctaagcgctgtcactttatgtctatcttatcgttaactctggaaaaagaaaaaggaaaaagaacgtcagggaacatgagtatatatagaaatggtttattctagttttttccgttttttcagtagatttttgcctttaaaagaataaatcccactacaaaaaggtaaaataaaaaatctattcactgaacttactgatgaaatttccaaatgtgccccgtacatcgaacgatgtgacagagaaaaatacgagtaggtaaataagccaaaaggcaagggtgtcctttcttaagcatcggttaggtttgcgggcgatcagtaactgaacaatgacacaagatcaagaacgtaatttgagatttttcaagatggtttttttaggtatctattaaaactactttgatgatcaatacggtatttttgtcgcattattttccaagcggaaggaaccgtgtgttcattttatgaatcttggtgttgtattcacagctacttctcctaatgccttcgatgcatttagataatttttggaaacattttttttcttgatgtatattttttgtattgtagaaatcgcgcgtactgtacttgtatatcgctttataagcgcttttaattgattgttcatgacgaggataggcggataggcggaggtatgcctcttaatatttataataaagcccaccaaatggcttcttctttttagaatatacaatatacaaataaaaataaaaaaatagaagaacatcctagtaattgtcttgaaaataatcaagatattgattgggattttttatttagggaaaccaaataattgcatatgcttgttacatcatcatcagtcatataaagtatgttgtccgtactaatggtggtatttaccttccccgagtgttactgataggaccaacaaacttaccgttagcattatgtatcctatgacttcccatctcacaattgtggtttgcgtaggttcgcaaacccactcagctaaccccataaagataatagctcccaggttgcacgtcgtcaaatactcagcaggggccttgcgattcaactctaatatcgaaatcaagctcggcaaggaaccaaagataatcgagcctagtagagagaaccaaaagctcttgtcattatagaacaacgaaatggattccacagactcacgggagggaaatttaggaataaatggcaaaagtattaccatgccaataataccgattagggccatgtgggtgctctgcttaaccaagactacagcagaattttcgttcttggaaatgttactgcaaaaccaacggttccataacacggcaaaaggacccataatcaaagcaccaaggccgcaaatcagagcacctttcaacctatcaaacaagaatgggtcagaaagttcacccgtgttagggttgacggacagctttccggcaagcatgtcacaggtagccttcgtgtatgagatgatcaaaattccaatgaccgcgttcatcatgatgaggaaattacggaaaacgtagttcttcctggagattccacaaacaccatatagtaaagtgacaatttcgaaaatggcagtattttgcatcaaagcaacatcaaatgccggtgacaatgacaaagccatgttataagtcaaatcagcgacaatcattatgagagccagcactgttagcttagccacatatttgaaggtagccacggatatgattttttgcttctgctgttgggctggaatccgtggttgaggatcatccaacacgtgcgagaacgtatcgacatcttcgtttgtcacagacccgctgttgttgttgtcaaactgagaattcctgttcgagtctgagtcagagacaaacatcggtctcatcttctcccaaagtcgagatgcaggcaccaagagcagccacgaagcaaaatacataaaggtcagatagaaggttaatgaacttgagtttccgttgtcgccgttagtttcaggcgttgcaattgtaccattgggccccacggagatttcctttttagattgtatgttagacaaacattttgtttgaatcacgtagcctattacacttgaaaaccaaagtagtgtggtagacatgacgctgtatctttgtttgttatcgtgctaactcaccagctcaagagcggatctgttctggaagaaaatggcctacaaacatttctttcacttgatcttcccacgttcacatagcctcctttagagtgagagagctttttttttcttgcgatacaccttcgccgggtgatagccgatattacaagaacgggttatagcgttataagtatatatgtatatacaaggaagaaagtagcatatatttacaatcttatttgaataagaaggagtaccatgcctccttctgcttggcgcgctgctctgcaggcacataactcttaacgtgttccacgatcttgtccacgcccgttttttcatcataatttctacccaaagcatcaacaaactgtccttcagggtccatgagataaaagaagatggaatggtctaccaaataatcttggcccggtttgacgtttggaggcgtagaaaagtatactctgtacttcttgcatgcgttcttcacctcatcgaacgtccccgtcaaacccaggatggagggatgaaagtcgctcaaatactctttcaatacagcaggggagtctcttgctggatcacaagttataaataatggctgcagagtaataccatactttgaagagagtgtattaagccatagacctagcttatccagttcatcaggacagatgtcaggacagttactaaacccaaagtatattatagaaaacttaccgagaaggtttttctccgtaaactcattgccatacatatcctccagatggaagggtcccccaagtgaaggtttaccgtatcctctgtttgcttcagcctccttctgtgtttccaatctgcgtttctccctgttgaagaaataagaaagtgccccaccgactgctaggaatagagcaatggcctttcccgtggaaaactcgatcgagccttctcgcactttgccgttatccttaatgggagtaccgcccacaggtactctgcttaatggtttcttgccatttgactgccataagcgcgttacagtaaagaatcccctttgagtgagcaatttagcgccattgccacttaatcttgcggctggcaattggaccaatcttagattggcacttcttgacaacttcagcatcttttctacgtttgctgttttttctgtttcccttgccttatacgaacatacgtttctaatgccgattataaacacaatagacacaattatactattttctcacttttctcttcgggagatcgctattgattattattcccgtttatttccttcaatttagggtctgaaaagaagatagtagggttagttttttggggtttaaaaccctagtataaacccctatactatttgtttatatatttcctatttgagtatgatagcatcgatattgaaatttacagaacttcaatttagtttcaattgggaattcgaggactctcccttgggatggccccagtctatttaactatcttccataatattactgttgatttcgtgactcagaagagaaaacagaggaagttacatatagacccaaataaaaaccaaagaaccacatatagaaatgacgagaaacccgtttatggtggaaccttcgaatggctctcctaatagacgtggtgcttcaaacctctccaaattttacgcaaacgctaacagcaactctcggtgggctaatcccagtgaggagagtttggaggatagctatgaccaatctaacgttttccaaggccttccggcatctccttcgagagctgcactaagatactccccagaccgtcgccatagaactcaattttaccgcgatagtgcccataactctccagttgctccgaacaggtatgctgctaatctacaagagtctcccaaaagagcaggcgaggctgtcatacatctaagtgaggggagtaacctttacccccgcgataatgcagatctaccggtagacccctaccatctatcaccccagcaacagcccagtaacaatctgtttggaagtggcagattgtattctcaaagctcgaaatacacgatgtctactacttccacaacggctccctctctggcagaagcagacgatgaaaaggaaaaatacctcacttcgactacttcctatgatgatcagtctacaattttctctgcagacactttcaatgaaacaaaatttgaactgaaccatccaacaagacagcagtatgtaagacgtgccaattctgagagtaagagaagaatggtctcagacttgcctcccccaagcaagaagaaggcactattgaaactagacaacccgataccaaaaggtctgttggatactttgcctcgtaggaactcccctgagtttacggaaatgagatatacagcctgcactgtggaacctgacgattttttgagagaaggttacactttgagattcgcagagatgaacagagaatgtcaaattgccatttgtattaccatgtacaatgaagataaatattcattggcaagaaccatccactccattatgaagaatgttgctcatctttgtaagcgtgaaaaatctcatgtttggggccccaatggctggaagaaagtctctgtaattctgattagtgacggtagagcaaaagtcaaccaagggtctctcgactatttagctgctttgggtgtttatcaagaagatatggccaaggcgtctgtgaatggtgatccggtaaaagcgcacatttttgaattgacaactcaggtctctatcaacgccgatctggattatgtttcaaaggacattgttcctgtgcaattggttttttgtctaaaagaagaaaataagaaaaagatcaattcccatcgttggctattcaacgcgttttgtcccgttttgcaacctactgtagttactttggttgatgtcggtacacgtttaaacaatacagcaatttacaggttatggaaggtttttgatatggattcaaatgtggctggtgcggctggtcagattaagactatgaaggggaagtggggactgaaacttttcaatccattagttgcatcgcaaaattttgaatataagatctcgaatattttagataaaccattagaaagtgtttttggttatatctctgttcttcctggtgccctgtccgcatataggtatagagccttaaaaaatcatgaagatggcactggccctctcagatcgtatttccttggtgaaactcaagaaggcagagaccatgatgttttcactgcaaatatgtacttggctgaagatagaattctttgttgggaattggtcgccaagcgagatgcaaaatgggttctaaaatatgttaaggaagccactggtgaaacggatgttcccgaagacgtttctgaatttatttctcaaagaagacgttggttaaatggtgcaatgtttgccgcaatttatgctcaattgcatttctaccaaatttggaaaactaaacattctgttgtacgcaagttctttcttcatgttgaattcctttatcaatttattcagatgcttttttcctggttttctattgcaaatttcgttcttaccttttattatttagcaggatcaatgaatttagttattaaacatggtgaggccttattcattttttttaaatacctgatcttttgtgacttggcaagtttattcattatttccatgggtaatagaccccagggcgcgaaacatttattcattacctccatggttatactgtctatatgtgccacatattctctaatttgtgggtttgtttttgctttcaagtcgttagcttctggaacggaatcccacaaaatatttgtcgacatcgttatctcattgctctccacctatggcctatactttttctcatcactgatgtacctagatccttggcacatgtttacatcatccatacaatactttttgacacttcccgcctttacgtgtactttacagatttttgccttctgtaatacacacgacgtttcctggggtactaaaggttccacacaggagtccaagcaattgtccaaggccattgtcgttcaaggtccagatgggaaacagattgtggaaacagattggcctcaggaagttgataagaagtttttggaaataaaaagtcgtttgaaagaaccagaatttgaagaatcaagcggcaatgaaaaacaatccaagaatgattattatagagatataagaaccagaattgtgatgatttggatgctatcaaatctaatactgatcatgtctataattcaagtctttacaccacaagatactgacaatggttatttgatattcattttatggtctgtggccgctttagctgcctttagggtggttggttccatggcctttttgttcatgaaatacttgcgtataatagtgagttacagaaataaagttgaaggtagcggctcatgggaagtctctaaattagacttaccaaatgttttccacaaaaagggctaatgccagtatttttcagctaatttctcgtcattccctcttttttctcattctgttttagaatgtacaggttatgacaaccattaccttctaggatattttgacatttctctcttagactttttatatataatatacatgtttcaataccaaatataatgtagcataacataatctatctttttactcatagacctttactttcctctctaaaagccgtgtcgcagtaactggtgacgctaaagttctccggcgtttttttatgtatgagctgggcatcaagaggcttttgagattttccaagtagtaactcatctttctgagtgtgctatcaaatacatactaaggagaataaactcttgttattacgtattcttcatccttatgggtagagagcgcactgttttagtacattttctagacgtcgaaacgtagagcaattgtcgataaaacaaaaaaaaagtaagaagatatatgaataggacgtgtcgctagaactagtaagtatatgatggagatataataagtgaattattcgatatttaatgaacgttctcatttatttggaagaaatgtttatcacgtgatggagaaccaatgagcggcgagtaactacgcgaggaacccggaccgcaataacgattaaagaaggcccggaagggagatgcttaaatgattatcactcagttaaaaaagacaaataagaaactattgagactgaaccgttttggttaatttcaggtggaaacaattgaagacgagcagtaaacattattttatttagtagtcatgttgtcaagaattgtatcaaacaatgcaacacgctccgtaatgtgccaccaagcgcaagtgggtattctttataagactaacccagtgagaacttatgctactttgaaagaagtggaaatgcgtttgaaatctatcaaaaatattgagaagatcacaaaaactatgaagattgttgcatctacaagattgagtaaagctgaaaaggctaaaatttccgcaaagaagatggatgaagcagagcagttgttttacaagaacgccgaaaccaaaaatttggatgttgaggctactgaaacaggtgctcctaaagagttgattgttgctatcacctctgataaggggttgtgtggttctatccactctcaattggctaaagctgtgagaagacatttgaatgatcaaccaaacgccgatatagtcactattggtgataaaattaaaatgcagctattgagaacccatcctaacaacattaaattgtctattaatggaattggtaaagatgccccaactttccaagaatctgctttgattgccgataagttattgagtgtcatgaaggccggcacttacccaaagatttccattttctacaatgacccagtgtcttccctatcttttgaaccatctgaaaaaccgatctttaacgccaagaccattgaacaatccccatcattcggcaaatttgagatcgacacggacgcaaacgttccaagagatttgtttgaatatactttggctaaccaaatgttgacagcaatggctcaaggttatgctgctgaaatttccgccagaagaaacgctatggataacgcttccaagaatgccggtgatatgatcaatcgttactctatcttgtacaacagaacaagacaagctgtcattactaatgaactggttgatattattactggtgcttcctctttgggatgataaaaaaatcaccctgcattgcctctttatttgacgttgtttttgtagaacatgaaacgaattttgacttgatgagacgaagtatatatccaaagaataccttaaatagaaaaggaaagataataaatactaaacactactatatattcaggtaaaatacaaaaattataacatttttaaaactttttttttttgaaagtccttctcgctttaggattttttcccattaagattatgatggtttcatgtatgtgtcagttaaaaaaaatatggctaagtagcaatgaaacgaaccaagaaaatgaaaacaatatatagtgctgttgaaataacaaagacattggtatatatttgtaaaatgtctgttaaatgttttttatctcaggttcttgcttgtctttggtagaagaaattatagtaaacaaacaaacaaacaaacaaaaaaaaaaaaaaaaaaatggtcgcaatctcaatgatttggttttttaccaagcgtatgcccagaatatttgcattagcttttaatttaatttcaatatttcttttgatttttcttctcatcggctgttacaacccgtcaaatcagtcaacatttctagtgaagtataaatttgatgacaactcacctttttatacgatcatagagaaatcatatgaaaaatcaaatacaactctgggcttggaggaagtcattataagatccggttacatgggtgtttgtattgataacattccctcccaatatagctcttacaataatatgactacattctccaattcaatttgctatgcaagaaagaatttaagctcggttcccttatacagagacttggaaattcaactctcaaatattgcatcttccagctccaaaacccaatcaagcgttgtcttgaacattttgaagttagcccaattaacttcggttaatgttatacatccatatgtcttgatggcaactgtaatcctaacaatcctaatgtttctatttattctgtatgtaactgtccctaagttaccattcaaactagcggttaataaatttctactgttgctaagttcaactatagttttgacatggggtattggtgcgatgtggactcatgtagggataaatgcaagttacagattggttccatcatcaagtatgaatataatcactgtcaagaagggcaagaaggcagcagtaatggcttggtttagctttgcattcctccttttagacagtgtggttttatggttaatatttttaagggataggaaaagcttgaaagatgaaattgataatgttccatgtgcccaaaataggtacaataactactcttcggattcatctacattgcattccaaagtttagttttatcctcaaataaacatataagttttgagcggatatttcagaatgtcaatttttaaaagtaaaaggagaaaaaatttatataattcacgattaacattatataatgtgatgaactacttaaaaaatttaacgttcgataattaagtaacaacagagaaaatatgagcttacctaaactctaatcattaccgtctgttttatttactgtcaccttgatgagcgactaaaaagatagaacgcgggtttttcgcgcaatgtaacaaagctccagaaattttttataaatactaatgttatagcaaaaaaaataaggaccttaaagtcgtaaactaaattgaaaagcccaaatcattcaaattctatatcgttgaacttttaataggctgcgaataccgactatgtctcccatacaggttgttgtctttgccttgtcaaggattttcctgctattattcagacttatcaagctaattataacccctatccagaaatcactgggttatctatttggtaattattttgatgaattagaccgtaaatatagatacaaggaggattggtatattattccttactttttgaaaagcgtgttttgttatatcattgatgtgagaagacataggtttcaaaactggtacttatttattaaacaggtccaacaaaatggtgaccatttagcgattagttacacccgtcccatggccgaaaagggagaatttcaactcgaaacctttacgtatattgaaacttataacatagtgttgagattgtctcatattttgcattttgattataacgttcaggccggtgactacgtggcaatcgattgtactaataaacctcttttcgtatttttatggctttctttgtggaacattggggctattccagcttttttaaactataatactaaaggcactccgctggttcactccctaaagatttccaatattacgcaggtatttattgaccctgatgccagtaatccgatcagagaatcggaagaagaaatcaaaaacgcacttcctgatgttaaattaaactatcttgaagaacaagacttaatgcatgaacttttaaattcgcaatcaccggaattcttacaacaagacaacgttaggacaccactaggcttgaccgattttaaaccctctatgttaatttatacatctggaaccactggtttgcctaaatccgctattatgtcttggagaaaatcctccgtaggttgtcaagtttttggtcatgttttacatatgactaatgaaagcactgtgttcacagccatgccattgttccattcaactgctgccttattaggtgcgtgcgccattctatctcacggtggttgccttgcgttatcgcataaattttctgccagtacattttggaagcaagtttatttaacaggagccacgcacatccaatatgtcggagaagtctgtagatacctgttacatacgccaatttctaagtatgaaaagatgcataaggtgaaggttgcttatggtaacgggctgagacctgacatctggcaggacttcaggaagaggttcaacatagaagttattggtgaattctatgccgcaactgaagctccttttgctacaactaccttccagaaaggtgactttggaattggcgcatgtaggaactatggtactataattcaatggtttttgtcattccaacaaacattggtaaggatggacccaaatgacgattccgttatatatagaaattccaagggtttctgcgaagtggcccctgttggcgaaccaggagaaatgttaatgagaatctttttccctaaaaaaccagaaacatcttttcaaggttatcttggtaatgccaaggaaacaaagtccaaagttgtgagggatgtcttcagacgtggcgatgcttggtatagatgtggagatttattaaaagcggacgaatatggattatggtatttccttgatagaatgggtgatactttcagatggaaatctgaaaatgtttccactactgaagtagaagatcagttgacggccagtaacaaagaacaatatgcacaagttctagttgttggtattaaagtacctaaatatgaaggtagagctggttttgcagttattaaactaactgacaactctcttgacatcactgcaaagaccaaattattaaatgattccttgagccggttaaatctaccgtcttatgctatgcccctatttgttaaatttgttgatgaaattaaaatgacagataatcataaaattttgaagaaggtttatagagagcaaaaattaccaaagggtttggatggaaatgacactattttttggctcaagaattacaagcgctatgaagtcttgaccgctgctgattgggaagccatcgatgcacaaacaattaaattatgatttgatgttcctgaattaggataaagtatttttccttgcacgagagtacgtatgtaaacgtaatattgataaagaatcaaaaaaagttttatatctatctatatatgtacctaataacatatggaaaggattatttaaattcaaaaaataaaacaataaagtttataaactaaccaaattattgttagagttggtaatattagcacttcagttaactcaatacgattgatcttgaaactatcggtaactgaatggtttgtttcaggatcacttacgaatgatccagtggaatagtacctttccattagagcatccttctcactccaaattttatacagccattctgaaaattcattctcgtcctctaatggaatatctttaacatcaaatgctctgatgtgaatatcgactaacttcgggtattttccttctaaaaatatgctcttcagcccatatataagctcaccatattcctcctgttttacaccggagtagccgatcgtaatatcataaagactttcaatacttggcttcaacttttgtaacgagtatcttaggcctgtagaatgaggcagtagcacattcttgaatggctttttgcctattttggcagcatatttagcacttttttgcctagtatcagcactgagatttgtaccttcagggaataggataagattgtatggccaatggatttgttttggatcaataacctccggattccatatgctctctccttcctcagttatgcgctcaggtgactttccagcaagtgagccggcgccccttgcattcgaatcaaggccagcaaggctgttgcttagggttattttgtcttgtgcccactttctactcataaaaatgaaattatagtttctcataccgaaaccgaggataggaatggaagccaacgatttttttaaaataatgaagacattagcccctaagttcgatgtgtaagccaaccaccataaaaatatccaatccgtgtatatttggtgattgcaaatggccaccgaattggactttagatgagaaagaatccttttcttcttcaagtctaaaaaaaaagtacctttaggaacactggaattttcagtggtaattctcactgcagatggtgcgacaacatgcaaaatggatgataccaagacaataaataatcttttggttttattgagaccaatttgtttccttatatcatttctacagtaaagagtcttataggtgagttggagaaacaaaagaataaggcatccctggaagaaaatcaataaggaaatacctgggacgacgacttttcgaactttatgagctattttttgatgcagcatcagcttattgacctcgctagcaatctcaataccagtggacctgatatatcctttttttttgttggctagtgttcattaatgatctttcgcgtttatatttctttttctgatgagtttttcgcctcttgagatgttgttgaacattatttaataatacttttagcacaataacgatttaccataaactaaagtaaactatgtatgtgccaccctatgaaaagtctacaatgaaaatatttacgcttccgtcttattaaccgatatgattaatcaattttgtcgtacaatttttgtaaatcgtagttctctctccagtaatcaccgtgctttttcagtattataagtacactgctagcacccaagacgataaaggccagcattgtgaaagcccacccagttcccataccgtttaacatgggtgtggtgacaaagactgcggttgcagccaagatttgccttattaaattattcaaagcaacaccggtggcaccctttcccggcaatgaatcgactaaataggaaagggtagcaccaattgtcatcatagctgcatatccaaagagggctgttccaattagtggcgttacccagtggcattttttatctaggcaccagccaaatatcaatagcgcaatggggaaagatattacagatgtaacaacattccacgatatacgagcttcaggagcaagaattccatatttctctttgtatctttttaaaagcatgtccacccaacgtccaccgtaaattgaggcgaaaaagtatgttacagaattcggaatatacagtagaccaatgtataatggtttaaagttgtaaggaggccttgaatatttatattcaactgtcatattaacaaagtatactgtggaaaaggaaattgcggaaaatgttattgcaagtgccacgggtggatattctaggaagtgcaatgattttaaaggcttgataaaataaacaaaaaaggtgtcccagaccttcctcaccgctgatacctgtttaggagcgatttcacctccattactggatagcacttttttgacttgctcttccaggttggtttgtaattttctcagactattttctcgaatcgatctcgctaactttggatctgttgatcttattctcgtaacttgtgctgttgttgcatcgataccgctatcatctagctgatattcatacagacttctactcgcctctgtataaatccgttgcaattgggtttctccagctcgaccatcataagtattggggctagagtgactttctaaatctagcgagtcttgatcccttacctctccaacgtagttatgcttctcagtagataatgtggcaacttggttttcaattcgatctgtctcatcttctcccctctgataatcttcttgtatctctccacgttcgttattgtctacttgaatacgtctttcagccaaaatttgagcgatagcgcctttagaatcttgttttcttaatgtttcaggtagtaacaccgtcaaaagaatgacattacatccggataaaataaccataaaccattgagtggatctccagggccagcgattcactaacaaagatccaaaaattggagatagtagcggcgccagtagtggacccaaatagtaataactcaaatttttacctctatcttcgctaatatataaatcagccactgttccagcacctacactttgaacactggcagaagcagccccacagagcattctcaaggcaataaatgagttgatatcaggagctagagcagacccgatattaaatgcaaacaataatgcaaatgaagttatgtaagtagttcttctgccctctagctcggatagagaagaccaccacaatgggaaaacaccaagacttaaaaggtacacaccaattgaaacgtttaccataatcactgatgttttaaattctgttgtgattgagttgatcgctggaaaaatgatagatgtgcccatggggcccatcatggaggaaaacgcaatcaagaagacaatcatctttttcatcatcggtggataatctctggcatccttgaactccggtataatggcgagttgaggcaatagtcccctacgttgattctttggaacaacgtattcctcactcttcaacctacttagctggttgtctctgtgttcacgactatttgatgccgtactttccagattggtcttttcgtaactataatcgttgtgctcgctgtgcggcgtgccgctgctttcatcgcagtgcatcataacatgattgttcggtagtgaattgtcagagcaattactcctcaaagaccctacattcgattgtgaaccttgggcttgcatgtttatcgctttctgacttcggtcctagcatagacgttaacaagttagaaagatgtgaatacatatgccttcaaccctgttttcttttaaggatacaaggacacagctattacaacaaattttgttggtttctatcttatctaatcgataatcttttaatattttaatctaatcgcagttatccaaaactggaatgagatggttcaaatccccaaaggtagatggagttactgctgaggcgtggaaaaacccgagtttttccgaagccgcatatgagaaattgagcaggaataatagatatttacgaagaggtaaaagtgataaaaggcagcgccgtggcaatatctatttacaatgactcattctgactatttaaaagtatgtaagggctttatctaggctttgtgccgttcaggcttttgtatacacatgtgataattgtattacagcttgtaagtaattcaatgaacgtttctacaccggctaaacaagaatccattttgctccatggctccaagtttccatcctttactgtgttcaccggttctgaatttggagaaaacttggccattggaaacgatttttcgtttatagcgcctgctatcaggctattgatctcataatagttgtacccatatgcattcttaaacgccacttctgatgggagaataactgctgataaaacagcattgatgcctaccttagtcatgaaattgggttcatttgctttcagttcattcaaacctggaattgccttcagtagggagatgccgtaacctgggatgaaacctttggccagcccatgacataggacgttatttaagcaattatctattgcatttcttcttctgtcgatttcgatttcgttatgtccaccaatgcttaaagtgaccgtattttggaggaaggatttcggaactttatttggaatcgcttcagcatcaatggagttatataagaatgcctcccctgtggtcgcttttatggattcgatactgccgtaatatttatccgcacacattttgcttggcactaaaggactatattctggtgagtagatgctgtcatatccgcaaggcaaccgtaagaactttataaaatcaagattctcctgtggcgctaagtcattgttcgcctttttagagtacttcaaaaccactattcggctttcattattttctctcttgtttctgttattgttaattgtaacggatgttaatgcatcacctgtgcaatctccgttaacgattaagagaacagattttctcaactttcttgcatacgttatcgtgggtagaattttattagcgtctcgtaacgtcccatcatacataagaactagcatatctttatcaatggaaactaatttcttagtaggcaactccagggaccttaaataggcttcattactatctaaaataccagctggatatttccaacccttggatacatcaacctcatcgtaagttttgttgccgtttatgacccgcacaatgtcatccgaaaacaattcataattaatggctttcaaaacccttttgatgctttggctgtctgaggaggacatagtcaattgctcgaccagagcatcaacatcgttttgacttttcactataatcttgttcttcgcaagaaaatctctgatatatcgtaatccggccttgatcccattggtcacttctttttcgggatacttgaaatagtgctccagtaaagagcatgtcaaagatgttgaagttgctgttaagttgtcctgaatgcaatccatgaataattgtagaccaaccctccccagctttcgaggcctgtttgattgaagtcgtgtgttggtagcttcatctacttgtagggaatctagtaactcacgcattacattgtgaagtctcatggtatcatgagaactaacgacctgtggcttggatttatacttaggttcatatatcaatgttttattgtaggaggatgaagttattattttttccaacagcttaataccagagagcgtatctctgagaacctgaaggttttttgttctatagattggggtgtgtaacgtttttaccgaacatttcgtttgatgatttcccaatttcctcaaacaattcctcagcatactcgttaaagcataagagagttttatgtttacagtagtgtgggagaaaataacgccaggttaaagctcgtaaaaggtaaactatcgcactatcgaaacttttgtttcacagggaatggaagaaagggcctttattttttacatttttttaagccataacggattttagttaccgagattttcaatcctataagaattacctaaactattaaaagcggacccatctaaaacataacgttcggcaagtagatgtattgttccaaaaaggcaatacatccatacaacggtgccaccgatctgtaatgaatgctccgtaatgtttgggggattcattaaatttactgctggaaccgagagagaaacacgacagagcaattcatataaatgaataaatgaaaactcggtcgtattgcccttaaacgtttataggaccaggttggctacttcctcatctcaattttgtgataggggaggtctgcgtaaggaatcaattcggataccttggtagtacttttaggggcacattttttatttctacttcttgtattattaggtatcactgagatctatctctaatgatgccttcactcccacagatagcggaagacattaatgcacttcaaatcaaaacttcttcaactaaagctactcttttcgaacgcagaagatataatttcattcctagagactttctacgaacctaaagtagcaaatttaaaaaaataaagagtttgatccaaccgaggttcgaactcgggatcttcgccgtgtaaaggcgacgtcttgaaccactggaccattggacccggaactcgatactatgtcatttttggatatcggttagttgtatacattggatatctcatctaaaagcattacgcatgccctataactggtaaattcaatgaatgttttgtaagttgaggggatgctaattccctacgaagtatttctatattatgtgcaactacatcaagaagataatattaaagttgttggaataagaatctgttggaatggaaatcaactatcgtccatcaactatagttatactactggtattatcatatacgatgttagatgatgacataagctatgaaaaaactgccattgaagttaaaggaagctgaaatgcaaagattgataatgtaatatgataatgaaacatttaaaacggaatgaggaataatcgtaatattattatgtagaagtatcgattccattcgaggattcctatatcctcgaggagaacttctagtatattctgcatacataatattatagccttaatcaataaaaaccccaagaattacctcaaaattcaccaatatctcaaaatcaaccttcatctgtctaccagtagtcatattattatatgttatcatatacagtgtaaaaaagatgatataaagattgaaaaacagtcatcagatgtttgggaagctgaaataaaatatagtaggacaatgggtgacaatatataaaatggagaaagaaatagtagccttattacgtaaaagtatcaatctcttttgtaaatttttgtatcctggggaagaacctttatcatattctctattcctaatgttataaccttaacaacaacgaaatcccaaaaattatgacaaaatccaccaatatatcaaaattcacataaagaaagccgtattctatataacattgcagaacatttttctaacacattaccaatcgtcaaagttctgcctttactaaatcaggtgctgaattttgaatcatatataaatagccaagtagtttgtgcggtcgattccaacgccgcttataatcctattccagcaatattaacaatgtagtcttaaactgatatggtaacgacagatagaagatagctgacccatattcaaccaaatatcttgtctagaaaggcgcatttgataggcaaaaaattgcacaggcgtattatctttgtatgctaatgcttttttatgttattcactgaatactaactatcagtagttgattccctcttagctacaaatgcataactatatgtataatcacgtagataatgtattgatgtaaagtgaaaacaattttacagagtattggcagttaagtgttgttttttcgctcaaaaaacatcctcatcaagcgatataatttgtgccccttgactacttatacctttcagttgcctaccaatgtttctttccgtagctctcatactaagtatgatatcagatttatcattaacggaatcttcgcattcaacagccgcaaaatccaaaggatattcttcagaatagtacttgcttagttgctctcctctcagtctataatttctgcttcatttctctgccttttatactctgtatattgaaaataatgtaaaaattgggctacacctactgtgtcacacttcgaagctctctgagactcctcatcatgctgtgaattcatctttgtctttagaattgacctcatttcagtagtcgaataaccactttgagtctcatctttgtttaactttttagattttttgtagattaaaagacgtgagttttcatcaaacctaacacttgaggtactccgatcctttatacaaagatctgtatccatttctgaaatgttttcgctgtcagataactctgcatcttcttcgttatcaacatatggattgaaagcatcatagaatcttttatttctaaaattcacgcatcttttctttttttgatgacttttgatcaaatgcgttaagttatcttggcttaaatcagctttaccaacttttgaaagaatttgtgatatattggtcctattagtaaggccgcgaaatgtggggatagtataaattttactacttccacttgagcttgtatcagataaatcggaaagttcctcagattcaactggctcgaatgtggtctctacatcatccgaatagctactgctcgcatcatctatgtctttatccaatgtatcatcttttaaggccgagctcacttcaattggtttttccattgcgtccaccgtgctagtattagagtctggtatgaccacatttccctctttctcagtggtaacatcgtttattgaatcctcatccatatttctgtattcgttatcactttcataatcggaggcactggaaccaattttgttagagggaaaatctactttttcaattaaaaacgaatccgtggagcttaatgcttcaattctttcttgaacttctttggtaatgtaaatggatggtgtactttccatcgaatgatccgattcaggttcatctgagtattgttttaagcatagcctcttttcagatgttgtatcactggaatcattgcgaatgcttcgttttgtgccacgtgtcgaatctgacctatcaagcgattcatttgattcaattggagtaaaagttgcaggcgctaagctttgcaaattctcttcaaaatgtttcaaatcttcatattttaaattattaaaaggaataaatttctcacttaggttccaacaggattcattgtctagataagccttctcggaattttggctcctatttgaatgatcaaattgcgtttcaaattctttcgaatttgtgtggaatctgtcgaaacagggcgtattattgtctggtttgtccagattatctgacacagacttttttgtttcttcaacaactggacatctcttttcgctttgatgtccgtttctcccatgacgtattttcttcaatccccttttcaaattatctttgaactcatagaattttctattactgaacagggtttcaaatttagtgtctcctcggaaaaaagaactctttccatctgggcactcatattttattggagttgtgaccaaaggacaatgaccagaatcaagattagaaaatgtgtcagcgggattaggttttgcaaagtcacgcaaatctaatgtatcagaatgcaacagggatccatgcgcagtcgacggcctcaaccattctctaaaacgttttcttttcaaagactcaaatggtctagcctttggctgcaaaatagtttccataattagctaataattgaatagctcttcaccaaaaaatttgcgaactgattcgaattataaagaaagccaccaaacgaataggcaaggaggaagaaaatagctatgcttaattatctatttttcaaataaaatcagggagaaaggaaagtacaaataaatttttattcgaatggttttgttaatatgtatttattttatttttgttgcacttttttgtcgaagaagtccccgatttttacagtgtcacacttaacaaattttgcgtcggaccagtttatgtagcccttcagaaaaatagaaaaataaaaaacctgtcataattcctagttaatctaagaagattaaaattcgtgaacacaaaaagaaaaaggcaagaaagctgtccaaattattacgataaatcaatatatgattctattgtggtatttcaagaactagcttaccaacagtttttctactttctatgtcagcagctgcagttctataatcccgtaatggataagttttgtatattttgatgttcaacttctttgaattaaccagaccaaaaaactcgtcagagtaatatttccattcttcaggatcggcgatatagccgtaaagttgaggtctcaccaaagtaatattttttggggaaagtctggtaatagagaatggcgggataagaccagatgcattaccaaaggaaacgaatacaccttttctttttagtgcggctaagctgatttcaaaggtatcctttccgaccgagtcaaaactagcatcaacgcccttaccattagtgaattttaaaacttgtcttaaaatatcctctttcgaagcgttgatcaagtattcggcgccgtattccttcgctattttaagcttttcatcagttgaggcaactgcaatcgtatgtgcacctttcatcttgagtagctgatttaaaatcaatcccacaccacccgctgcggcaaaaagtaatacatagtcgccctttttgacgtgatacgcttcgtttgtaaatgataaagcagtgagaacttgtaataaaccagccgcataaagtttcaactcttcgtcactcgttccctttggcagcttcatgactgggccttgggacgaaatttttgaatactgtgcaaaagttgagttagatatataagcaacttggtctccaacttcaaaattagttacccctttaccttttgctacaacggtccccgacgcttccctgcccaatacgtatggtttttcacagggataaatacccttccgaaagtaactttcgatgtaattaacacccgtgtacttatttttgattagtaactcttcctccgaaatcgatggtacaggataatcctcatacttgattacatcgtatccaccaatttcatcaatcaaaatgactttttgctgttctggtatagtacatttcatttttgtcttgttgttagcgatctcgtctcttaatgcttactagtagcttcaaaatatctactttgcaaaccgcaaggagatctcactttcaagatatagtatttgtaagaggggaagttaacgctcggctaaatcgttcggatcgacaccgagcggcacgtactatattatccgaactgattactcatctagaaatgaagggtgcaacttctaatgtcacgcaagaagtgaaagtattattcatgttatacctgaataataatcatatgtaggagtaaatctttgttctgtgaacataactgaaaaaaaatcagttcatcaatgcttatcaaccacttgagtaagatccgaaccgtaaggcacttttctaatattaaacccgttttatccaaggaagtttcgcgacgagtaattgttgcacctgcatcacacttcaaaacctccagtccaaatgtgaaaagtaacatccctattcatgaatataaacaactaccggaagattctaactacattgaaaagcattataaggaactacaagtatttttgaatgagtttttgattaagaaattaaacaagacctatgcggattttgaaggagatccagacgagttggtatttcaattggaaaaattcattgaactagaagttactccgagatacacaaatcattcagcacctgatggttgtgaagagagattcaaatccatcggagacaggatagtcgttgaccgctatttagattttgtgaaagatgtcagactaacactgctgctaaatggaggacactccttcatatttgatgtcatgctacaagccaaagaagtatttgacaaaatgcagaaagaatgaagaaagctataaaaaatttgaattatactcattcagttagttttttattagtaatgtacaagtaaatagcgtataatatataaaggttttacgtttctctcagtatctgggaatgccttattatcgatatacacaagaatttctggaagaaatatttccttgctgcacccatacaattctaaacccaaacatgtttcccgctttgtttttattccacactcggcatattgcgtctatgaaaaagatgcgaagtgtctttgtgaaatgaggaagtgttctcgctagagtccgcctggttccacgccaacctttcagcgggcaagtccaatagctttacgtttcccttctctgctgcgtctgttgaaaatctataatcaataggtaaaatagtgataataacatagctagtacaatttacatagtagcatttgctgaagacttagaggaaacgtatcaagccagggaaaaagatgtccactgaattaactgttcaatctgaaagagctttccaaaaggtatgaaagaattataacctgaatgaggtaatcaatgaaatattcagtacggaaaggaaaattgctcgaggtaatattataattttaatgggaatttccagatttatcaacataaacgttagcaagcgcagtaccatcaagtaaaagtttactggtgaaaagcaggacctcgaatgattgagatttcgttacacagtacgagtaaaatataaattatttcaagaagaagagaacttttgatctgaaaatgaaaatgtaaccacggagaaatgttgagaatacataaataaccatgaggccaaaacaccttaatatgaagtataacttttactgtgctcaatgactatttcacccgactaatgccaagtaaggaggatctccatcatacggaacaattttccaaccgccacgacacagttaacgatttccttttcgcctaaaaatagtaggaatgaagttcatgattatattttagatcaaccggtttactaacatgctatttttcatacagcaacctcacatcttcaacaatccaaaggtcaagacttccaagagaaccaagagatggtataagaatgccggtttgggattcaagaccccaaagaccgctattgaaggttcttacattgataagaaatgtccattcactggtttagtttccatccgtggtaagatcttgaccggtaccgtcgtctccaccaagatgcaccgtaccattgtcatcagaagagcttacttgcattacattccaaagtacaacagatacgaaaagagacacaagaacgtcccagtccacgtctccccagctttccgtgtccaagttggtgacattgttaccgttggtcaatgtagaccaatctccaagactgttagattcaacgtcgtcaaggtctctgctgctgccggtaaggccaacaagcaatttgctaaattttaaagaaataaaattaacaagatgatataataataagtggaggataaaacgtaggacttctggtgaattatttgaaccaaagtgtcgtatattaggctctttttctttttcttttaccagacttggtttttttctctctttagtaattgtttctatatatggcttatcaattctatatattttttaacttgaatatatgaatgacatctttaataatcacatctcggcaaacgactgatgagttccacctgcttattgtttatttcctttcgtacacgccgcgcttggccagtccttccaagaatgtaggcagaagaaatcaaactaacttgtaagagaaagaataaaattcattatacatataggtaaaataatataaatacaacggctccatgtgtaagttggaaataaaaacagttggcgtcaaggaagaaaaagaaagtcaatatccggcaataagtgaagacaagatttgccaaattgttacagggctaaaaaaaagataaatgatgaaaaataacgcgtactatcaaacattattgagtttttcgctttcaccaattatattttccggaattaattttctgttttcattgaaatattggagctaaaataatcaactagctctttactgatttcattgattgatttttgcttatagcctttgacctttttcttcattctttcatagcacaatttcaactctaacccatttaatttcatgccaggcttcaaagctgcaagttcatcccaatctacttgagaatcttctgttatacctaaatctcttaatttttcaaaaatccataacatatcatcatcttttacagtctgaattttggcaattgcttcccttttgaccaatttattccatttataacgacattgaatacgtgatctcgtaccgcccatacgctcactgacaatggtccagttaatgatgtctttgaaatctaacttaccgttacccatcaaagatttcctcagtttattattgtgacgtctgattgtatttgacaaacttttagaatgtgtgcttgttgctgatggagcaggtaccattgagttctgggaattatcatcgagctgtatacctaatgaatcgtggggtttgtcttcgtctttgttgtctcccagggatgaagaagcagcagcggcagcagcggcaatagcatcgtcatcatcttgctgcttttgttgaagaagttgttgttgttcttgaatagcagcagcagcagctgctgctgcagaagctgtatcatcatcgtcttcatcgttattgcgatgatcattctggtcatcttgcagtaaatgctgttcttcttccaataagtttggatgcaattgagactgttgttgctgggcttcttccaacatatcgctgataacctttttcagaagctcttcttcttcaacggaccatctatttgatgctctattggtaccacattttacgtagtttctccaacgatccctacaatcttctggcattctgcctaaagttttacctatttctgcccattgaccttctttttctgcacataatttagctagctcttgttcctcctccgcggtccatttaccacgttgttcaaaaatgtgatattttcttctcatgtgtttgtagatagaggagctagatctatagggtaagactttgtaaatattattccaaaagttgtcctttggcctgtcggaactccatatcctttcacaaacttgttgtctagtcaaacgttcaatggcctcatactcgttaataaatctttctaaagcggcgtcttcggctttatcaaaagctttgctattgttagaccttgaagtcgatggcgttgctgaggatgaggataaagataccaaagatgatgcctttgtggcggctgattgaagtagttgagatatttctgaattgtccacgctgccagcttcattatcatgagagggagatttttgttggtgtggttgagtatcttgagagataactttgggcaagacttccatataatttctagatttgttgagggaactatccagcatagagtctttctgcagttcagagtattgctttgtactatttgataaatcatctgtatcatcattgtgattcttgttctgatgattcaaaccgtgtgtacgcatcaaatgatctttaatatgctttaatttttcgttatcgtcagtatcagccgcagtattcaagtattgctggaaatcaggatgttgggtaatcgaatcagcgtcgataatggccttatggaccagttgatcacgatcaatcacatcattattagtatcgttgtcatctgcatcacccaaggtggttaattccggatctacgtttccaatttgtctgtcatcgtcatcattattgtttttccgctttttctgtgaattctcatgattatttccgttatcatgctgtcttttacgcgaattgctatcgttcgcaatactgttattattattgttatttttcgatagagtgtaagcagcagcgacggcggccatcgccatagattgatgatcatcgtccacaccaacacccgcatctttcttattcttgtcgtcgtcgtcatccacgactatgtcagattgagaaaagtgattattactgtcattgccgttgtcagtgttattattgttttcgtcatcttcgtcgtcttgttgattatgcgctgtttgccttaaataccaatccataactgcgttatgttgttcattggagttggcatgatccacattcgaagatgattcgttcgcattcaatgcgctaatattttcagaatcatcattattatcctcgtttctattactgtcatcattgttattaacatcaacatcactactactttccacaatattctgctttttcgagtgtttgttttccagatccttcgtatgcaattgagggtcatggttctggtgatctagacctacaccgacatatttcaaaacagcctcttccacagactcttgatttgcgtttttatcgttatgacctgaaggcatattgattgagctataaatattctaattcagcagcaacacgtgagttcaaactaataacgatagtgtgtagataaccttgcttgtgatgatgtttatttatttactttaggttgggtccacagcagggtaataacagcctgagttttgttgttttatcttgtgtggtcaagaaagctgccatttgtttgtcgttgtcctttgtgagggtaggtcccttggccgcctttggtttgccacccggcatgggcccaatttgaaagacgggtaacaaagttgttgctatatatcacgtgatcaatttttccgaggagcttctagaagaaaatgagacacaatttcaatgtattgaaagtttacgtaaaatttataggagcaggttgggtatactggtgtctatgtaagcgtcaatgtcattttctgtttcagcgtcagtatcagtatcagtgtcagtttccgactcgaaaatgaaggtcgaatgacttgaagttgacgaaggttttacgggggaatgatgacttatgttggataacttgagatcggagtcaacccgaagcacactactgaaatctgtttctcctgcctgtaacaaaacatttcttggaacatcgcgaacatcgtgcccacgctgatagtctccactattactactgataatggcagtggcagcggcagtcgtaataattgcgtcactcgcgacgtaaacgctgttataatcatagaaacttcgcttacttgctgcgttgccaatacagggatctagttcagactttgaacaagggcgctgttcatcagtcgaattcaaccgtgtagaaggaagcctttgtatgaaatgctcatcagttataatacactgttcaacgttatcgttaaatttgatatgcctctctcgtggcttgcccattatatctctccttttgcgtgccttaaaccagcttctccaaaaaaggttctccaatctttgatcattgtccactttcttgtgtttttgtaacggtaaaacattttcattttttacagtgttgttcgagcttctcacatgcttattatttttattgtaattgtttttactactacaattgataaacttgatgaatttccataaatttaaattcaagattaaacttctttgctcgtgaaagtcgaaatttttcttctttactgctggcaacatgcacattcttttcttgtttattttccactgtttggcattcaaagacttgattttttttaagcaatacgtaccatttgcagcggcgggaggatatcccatatcgtttctattcatcaaagttctgaccgcctcaacgaatttactactttcttcttcctctggagggtcctggaataagttatccaaagagtcgcaattactcaaagtcattctcacacactttcttgttcctattttttttttcttattccaatatattattttatcagaagacagacagcaagaacgacagcctaagtttcgagacaacgctaaatttgacggacatgcgaagacatgccatatataacagtacgtccaggaagaagctgcaactcaagaagcaataactattttatgcattattagttaattaaagggggtatggtgtggctaaaaacgagtaaaaaagcagcttgttgcgatgttagtaatgataactataaggtttccgtgttgacacaataagcgtataaatttaatcactccccccacgtttttttatccagtgctgccccgccacatgcaatcgggccgtcggaaaagcaagagaaggacaaactatcgggcaaatggcctggaagggaccttccccattggcccttgactatagtccttcagtccttcagtccttcagtccttcaatgttacagttataccatatcgtacttatgtaaagatatatacggttttacaaatctttgatacggtcgtaaaaggccttcccttgaagttggtgaactcttagctcggataaactgggaggtctgccaccgtcgattccagaaacacatcctgcgccccaggcgcaagacccgttcacatcttcaacgtcggtcaattccttgtatgcgttcttataccccaatgggacataaatgacaccatgatggaccagagtactcattgcgttcatgatacacatttctgtatcacccttgccgcttattgcgcctgaaacaaacaaaccggcaattttgccatggagagaaccctttgcccaaagcccaccagtattcgagtcccaaaagcttttccactccgcggggaagtttccaaacttagtaggtattccgaataagtagtaatcgtactcaaccaacgtttctcttgttaggattttataggaaaaatctgcattagttttggcgactttggctgcctcttttccctcttctgtcgcatattcagttttatagctgacgtctggcacttggaaaatctcagcctcaccaccagctatctctataccttttttttcattttctgctaatgtggcaattatatcgtccactgaataaatcaaaatagcgactttcggcattatctatgtggcgtagtatgtgcttataatagtgagtagtatgctggaggtcttgatgttcgatgtttctcgagaaaagtgtgatataaaatgtggtttctttttatttcttttcttttccgctcttttatgtatttttgattgtccgccccttaggtgttccctccttataactaggcaaccaaaatggaacggctattattcgatgtataaggacaagtttgggagcttcgcttcaatttgcccataagcggtgtcatatgacgctagttacatgcgctggatacgtatgctgcatatatataaacatatgtatatacacctagtggagaggttgtcgctttgtagattccagaggaacatttccgtctagcacgtttggaattttgtagatgcagccaccattcttgtcagtattggttcttacagcatcgttgatttctgcattggcagtggtcacgaagagatctttaccaacaaaacaacaacatgaaactcttggtgtctgctccggcaaaatgaactccttcagcaattttccgttagttaaatcgaacatttgaaccttactggtggaccagacagtgataaacagaaacccagaatgttttccgtctttgctaaaccaaattgcacttccatctggttcaggagactcaaaagattgattgttggagttcttcacgtcaattaactcgtcacgttttagcaagtcgccaccaggacatttccaaatagtgaagtttaaagaatcagtcacgtacatcgtcttttgatcactttcatcccagtggatcgcgttaggaattaacaagcaattccaaacaagctctatcttgtgagctaataggtcaacacgaagcaaacacccaataggttccaaatcaaatggaaaatcgctcattagccccacataaatatattttccatctggcgaaacgttcccatcattagatctcaacttatatgctctgtctgtactcaattcaggacattcggaatacaaaatgacatattcccattcacttttgctaaaatccaattttcctatgccaaatttactaccaaataatacttgtttgatttcattttgtgaagccccatcaagtattggaaatatacagcccacggattcttttaattcatctggattgggagggtactcaattgacgcattcttgccataattggctctactaatggaaaaaaaagaatgactggattcaggctgttctatgtcttcgactttatgaacctctcctttaaaaatatcaacccacaacagtgtaccggtttccttaacgaaggttattccttcactatgtatggcaccgggaacgtgataataaggttttaaatcatgcaaaataatttcttcaaaatcgccaacactactcattttacgaaaagtgtctagttgctcaatgcatataaacttaatctaagaatcttacaggacatcttcatatatgtccatatgctttgaataagcattggcttccccttaaagcccgaccgggtaaactttcacctagctgttcttggcgaccattaaataattttgaatgcatttctaggaacaaaatcaagtgcaagctacagctttacaattatagaatctgttgaccaagtaaaatggatgagaaaatttacgtacgattttgttccttatccattcagcttctcagttagtcaagaggtagctgtagcggcttaacgaaaaaggtattaaaaagggacatactttttttatatcttttcctttggcgttcacagttactcttttagaactccttgttgttgtgtaatgcatttacccattcccgatataactaccactttggagaactgtagacaaagaccgctcttactgagtatacattttactttcgtagaccgacttttaactctattaggaaaagcaattgacttttgaacttcgatgacgattgtgcaaaatacaaatcgtttcaagcggtgttcggaatagctcacagaaatggcgaagatatgttgaaaaatacataccgatgtcatttgtgaaaaacaaaaacacaagctacaatttgtatatttactcaattacatataccaattgagtaataattaaacaagaaggcaaaaataaactaaagcaaaatagtataccatctttggttcctggaccacattttctctcaatatttttgagatgtttttctttactttgttttaagtagtctttccatctcccttcaacggaaacaagtgcacgcaacatgttattttcctgttatccgccctgagcagttttcttccccgggtggcaaccattctccaacattagacaaactttacaaagaagacaccctacccggttgcctccaaagcccttctttcttaacgcgagtaccgctttgggaggcctcatcttggttgtgtcctcgtatggcagcatctgccattgagcgaaccctttcccgttttacgcgcatggcctagaccgatctttagcagacatgccgagtgaatttacctaagatttctaaggactcttctgcatgtttccgaaaatcaccggaaaaaccttcggtttttttagacgaaaactaggaagttgcttagctttccttgtcgtcttcaaatctatatgccatcggaagagaatcagaagagaagatcacgacttaagagctttgctgttaagatagcaagaaagcttgccaataggcagttatgtaacctagtttatctacaccttctttgattaacttagctatgtaggccggtgtgtttgttcatatcacggcatacgttaacacaatgtaaatcttgctttgggttgactgagggaaataactatagacatcacaccaatggctaagggatatttcgacctcgctatgggttctaaatgagggaatggaaaaaaagggtaaattgaaaacaacctaccgattttggtaccacttccgtgattttcgattcttcaatttccgcataatttgcctcaaataggaaatctgagctgtttttttcttaccctcgagtggtcgttctgcggacttttctccggtccaatgcatgaatccctttaagaagcatgaagaaaaaaaaaaatagcctcttgtaaaagcaaaaatgcctttcactatttctgtgtaaacgaataatttcgtcatcttagtagttcactggataattgtgctttccaatcagattagttagtaaaacccctagaaaatttcaatgttagatcgggatgattcctcatcgggttgttgcttattcatgatcctttcaattactggaagcttaccgaaaagatatataaagaaccgaacttattcggtttacatgtaagacagtgtgttagttatggttttccgcccttttcttctcttgttttcttcgatatttgttattaaccttttctcatttacgattatataatcaagtgtcaagattgtgtcagcaaataacagtaatattccaacccgaaaaaaactatctatttatctttggatactttaacatagacaagaagtcctaagaacttaccataattttttttctaaaaacccttttttactcaaaactaatagcttattctggttatttttaatcaatctagaatttttttcttttaattccaaacaatctaataacgtttaaccactaattctttaattattaatatttaattttaaaaatcttctaattttcctgataacttaaagtgacactattttttaaaaaaagcatcaaaatgtctgattatgttgaactattgaaaagaggtggtaacgaagccatcaaaattaatccaccaaccggtgctgatttccacattacatctcgtggttcagactggcttttcaccgttttttgtgttaacctactattcggtgtgattttagtcccactaatgtttagaaaaccagttaaggacagattcgtatattatacggccattgctccaaatttgttcatgtcaattgcttatttcaccatggcttctaacttgggttggatcccagtcagagcaaagtacaaccatgtacaaacttctacccaaaaggagcacccaggttacagacaaattttttacgctagatacgttggctggtttttggctttcccatggccaattattcaaatgtctctacttggtggtactccattatggcaaattgctttcaatgttggtatgactgaaatatttactgtctgctggttgattgctgcctgtgtccactctacttacaaatggggttactacaccattggtattggtgctgccattgttgtttgtattagtttgatgacaactacattcaacctggtcaaggccagaggtaaggatgtctctaacgttttcattactttcatgagtgtcatcatgtttttgtggctgattgcttacccaacctgttttggtatcacagatggtggtaacgttttgcaaccagattctgctaccattttctatggtattattgatttgttgatcctatctatcttgccagttcttttcatgccattggctaactatttggggattgaaagattaggtttaatcttcgacgaagaacccgctgaacatgttggtccagttgctgaaaagaagatgccatctccagcttctttcaagtcatctgattctgactctagtatcaaggagaagttaaagctaaagaagaagcacaagaaggacaagaagaaggctaagaaggctaagaaggccaagaaggccaagaaagcccaagaagaggaggaggatgtagccaccgactctgagtaaatgctttgatctgctgatgtagcaatgtttttttccttctttttcctgacgtattattatttgagaccgaaacttcgctggaaaagaaacacttcgatcctttttttatcttctgcattataacgcgcaacgatgaagtgttaatacatgaaagaagatgggattggattgtagcgaccaaaggccacaaataaatatgcactgtttttaaatttttttttcattaaaaaaatacgaataaattccttaaacacatacatcattttgcttcaaatttttacgtttgtaagaaagaccatttgttgtcttaatacctatgaagcactacttataatcttaattaaatctaattcttttctttaactttttttttgagcatcgcttctatcaattatgtgtatacatacatacatacatataaatatacgcgcaggctaagtagaaaacaacgcaagatagaattactttatttgtcattcatcaagcgcaataaaatctctctaggtgtgcagtattgcatttttacgttcttggaggcggctatccattcgggtccgtaagtaggctcacattgatcgaacatattgtagagatcaacagtatccttgcctaaccttgcatatgtcctaaatagccaaacccatgtatctccgtaacgcgagcactttttcagagctctttctaaccattttaatgatgtttcatattgcgcttctgcataaaaggatactccaatctccaaaagaacgcgatgatcgttttgtgtccttcttaaagcatcttgaaaaattgttttttttaacgaacttttgtttccatgcttaaacagcttgatttgctccacccaaagtaaagcattgcttggaaacttttgcaatgcctgtgtgacgagtaactccgcctgatctaagttaccaagtcttatttccatttggattttagcaatgtaaaataatacatcgtcaggattttttaacaatcctctatctaaaattgatcttgcccttactggattttttagatcaatctcgtcaatctttgatagggaaacccataataaagggcaattgggcactaaccttgtaccagacaaataggtttctctactcatttcaatattgcccatggaatgataaatttgacccagctgtaaaaaaaatttgtggcagatgggaaatgatttcaaacatctctcattcaagaattttatagcctcttcattcagatcttggtaccgcagaaagtttacgtatttataatataatctttccgtgccactgatcttaaaatcctctaaagaggagaaagtttgctgaaaaaaatctcgtaattcatcaagttgtagtgaacgacctaataactttatcttgaaaaagcgtaaatccaaattatgcggggcgaaatctataatctggtcaatcaaaactagtgtttgcctagtatcccctttttgggccttccaatattcgcttacatacatcattaacaagccagggcttttctccctcatatttgctcgtatatcatcactattcttggtctgaaatagcagctcctggaaaaatgctaataactcttcaattttatggtagctttcagtggccattttcagtctagaccaaagaactgtatcacaaggatcccactgaataagcttttttaagacagcaatttgtacctttgagtgtggcattttttctaatatctgatcaacattattcaactcagactcatactcgccactttctcttaaccattctaatatagcgtaaacgatggcttgacaggttaaatttgaattgggcgcatcatttagagcctctgcacgtttcaaccatgctgacaaggtcgctttgtacccatttttagagagttccaataaaccctccttgagcaaactaactagtttatctacaggtatatctgggttatttcgttcttccaagagtgtagagataatccaaatttccggttcttgcggaaggatttttctgaaggaattcaaagtcattttagcattatgatagctttgcaaattagtatatgcagtcaagagatccatactttgtggaataaattgtgtggctttctctaacatttttataacttgcgctttgtcagcttcaaaactgacagctagcttccataggccctcatctcgaggaatctcttgcagtgcttttctcactactctatatttgttaaccgttgtgctttccaaatcaatagctttgaaccaaagaagcggagacgttggattaaaatttattgccgttgccactaatgttttacagtagtgaacatcagattcgtgtagtctaatgttttctagccaaatatcggagcttcgagggcactcttggcaaccattttctattattttttttgctactgaaaattttcttgccttttcttctaatctggcagaagctatccaaccctgtggatttgttggatcggcctttctgtatgactttaaaattgtgcgcattttctgtaaatcttctaacgttgcgtctgagagagaatttactctatcgttttctaagtcctttaagtaacttagggcatcggtagcagcgttcggtttattaacctgtatagggttacttgcattcttcgttaattgtgcaagattctcatctatttgagattgcaataatttttctcgttcttccgttaatttatttaaatcaacattcccaggtattagcgaatccggtgcagcataagtttttctgtttaattgctcttgaattctatttctcttgtttcttcttgtaaaatctgtggcatccggaatatccatccactcactctccgttacagcagctaatgattctttcaaatcggcaaattgccgtttcacgtttgaagaatcaactgaattgtcatcatccttttcattagctcttttctttttcttttgtgctaatttcaattcaagcgttttgaatacatttgcagcttcatcatcttcatcatctttcggttggctttgaagatggttgttcaaattttcacggtaccttttcggtattcttcttcctttgtcatcattactaaccacttgcttttcttttgttgaaaatccagtggctccacgaccaatacctggtacgtaacctgcaggtggttcttgatccaaaaaagatggcctctccataaaatgtgacgttttcttgctgttaaactctttatgtcaactcacccgtatattttctgaaatttttcgtttttttttgcttaatagaacaatctgacacactataaatgtactggttaaattagcccaaggttctatcaacggtaaagaagacttttaaaaatactttcgttacattatttattaaaagaagaaacgccatcatttcataaaggtctccggaggagctactaaagaaagagtgctgcaattaatacaattaatataagtgtggttattgaaaataactattcatttatacggagggttggccgagtggtctaaggcggcagacttaagatctgttggacggttgtccgcgcgagttcgaacctcgcatccttcagtaatatttttttaatatacattttctctgccatcatggcttaaaaaatgcttaaaagaagggaattaggggggatggatgaactaagacataactttcttttcttcaattcgaactctgttgggaagagttgctttaaaaaagactctctatccatctataaaatttattaaaacttttgaactgcacagaatgattggctcacttagaaacaaatttgagcatttcaaagtttctgaaaagggaggtcaaaatttatctacaacactaccgaaactaccccctgcaaaggaccttgatagatcaactatctacaagtaccgttacaattatggtgtaaacttgggtgcgttatttgtgctcgaaccatggattttttctaaagaaaccatttgtacaatcgatgggaaagaatatgatagcgaatttgatgctatttcccaacaattgaagaagcattcttctgaagacgttgcgaaaatgttaagcgatcactataaaaagtacattgatcgaattgactgggaatggctatctaaagatgcccatattacagcgttacgtattccaattggatattggcatgtcgaagatgggaagcatttagattcgcttccatttgccccattgagaaaagtttatgagttagccaaaccttgggaaaaacttggcgaattaatcaataatgccaagaaaatgagcattggtgtattgatagatttgcatggtctaccaggaggcgctaattgcgactcacacagtggctcgaagagtggtgaagctgcgtttttccacaaggaaaagtacatgaccaaagtctacaaagatattttacctgcaattattaacacaatgactctgggcaacgaaaacatcattggtattcaagtggttaatgaggcatgttttgataataacccaaagggccaaaaattctattattcagaagccattaataccgttgaaaaacttcaaccaggtttacctgtcataatatccgatggttggtggccccaacaatgggcagactgggttaaagaaaaacattttagtgaaatagtggtcattgattctcatgtctaccgctgtttttctgattctgataagtcgaaggatgccaattccattatcaaggatttgccaaatactgtgaattttcctcatgaagatgccgattatactgttggtgaattttctggtgttcttgatggacaaacttggaataaaacttctggcgacagagacgctattgttcaaaaatacgtacaaacccaagcagatgtattttctcatgtagctagttggggttggtttttttggactttgcagtttgaatacggtgatggaggtgaatggggcttagctcccatgatgcagaaaggaaatttaccaaaacgtcctcacggtgatgacttacaagtcgacaagaagaaaatagattcaataatccatgaacacgaggcttattggaacggtaaaggtaaaaattttgaacactggaggtttgaggatggcataaagacagctgttgatgatataattgcctttaggaaatttgacaattcattaattggtagatggcattcatggaagtcgcaaagaagagctgaatacgtttctgccaaaaaagatagcgaatttatgtgggaatgggatcaaggctaccaacgtgggttagatgagtttaataagtattaagaaatatacaaacacatatatactaactataggcgtttctattcttttggtttactgtcgaaaataaaaaaaaagctgttgtggcggcacttcgtaagttttcaattatccagctactgccagtagagtactcaatacttttactttcagctgaaatgaggtttttctttaaatgaagttgatacgcaatatcataaaagcaccggaataatggtaatcaagatgaagcgctatgatatttttagtatttgccatcttcaaatcattctattttacccaatagaacattcaagtaaggtgaactatttaaattaaaaactcaagtaacatgggcgatctttaagcatttgagagttattaaaaatttccgaatagagcaataatggaggaaattaagtaaaaactttgagccaaaataaataatattacaaagcaagccagagtctctttttaatcagaggaaagatgagttgataagcgtataagctactctgctgtgaatgtttgaatcaacctcccaaaagatgtattggaggtattaagctgccttgaagttgggatttggcagggttataaaaaaggcgtcattggctaaacatgcagccacacatattgttgtttcatagccataaactttgatataatgaccgaaaattgtttttgcgttgttccataagcccagctgcccgttgggtattttgaacttttgtcgccaggtatcggccgttcctaatattatagtagcttataccatcaagaaagacactacatctaactactcaaacaaaagtaaccccacggttatgttcaccgagttgcgtacggttaacatgtattatatggcagcgcaaaaagcgatggctgtgacagatgatgaagtcatccatcggtaattgtccatcttaggtaacaattgcgaggcaagtaacacagactctcgagtacttgtttttcagggtgtgagaagagccgttgtttacttagtgataattcacgctattttgttgagcaagtcattaaacaatctactacctgtagctcgtgagtggaatatcaaggtgatatacacttttgtgttctaatgaaattcaaatactaatattgacgagttttcatattactagtatattatcatataaggtgtaagagaatgacataaagattgaaaaaaagtcaacggatgtaatggaagctggatgacaacttctacaatgaaaggagaataataatgctataatgtcgaaatagcaactctctttgtgaattcttcgcgtggagtaattctagtgtcttttgtattcacaatattatagcgtttgaaaaacgatgtacttccaacaattattccaaaattcatctatttctcaatggtaattcctattgatcaattatttttcaaaccactcaatttaaaaaattgtcagaaataccatcaataaaagggttttatagtgtagtggttatcactttcggttttgatccggacaaccccggttcgaatccgggtaagaccttatttttatatattttttcatgaattatcggacactcttagaatggagatctcgcagatatggggctgagccgtgctgcatcagttaagaaagaaataagccacctcgatgctgtggtgaataatttacgggaaatttcttggcgtttctgtaagtgacatgatccgttatagtgccgcaaagccaaaaatgtcttatttttaggttagcatcttttcagcctcgaaaaatgcttgttcagcaataatatataaaagtatcagtaaaacaacactttttgttagatgaacaattgattttgtctaggtccttgtactttgagaaatatcatcaaaaaaaaaaagtgcgacatcacaatgagacatcaatactatcaaccacaaccgatgtattatcaaccacaaccgcaacctatatacatacaacaagggccgccgccaccaagaaatgattgttgttgttgttgtaactgtggcgattgctgttcagcaattgcgaacgttttatgttgtctgtgtctaattgatctatgttgtagctgcgctggcggcatgtaagctgtggtttgccttgtaagctgtggtttgccttgtatcatcatgaacgcttttcttcgtggagtagtcttcctatattgtttccggtggttaccatcaagataatttacacacacaaaattttccgctgtacgtttgcgagtggcataacgaataatatgtatcctatcatttcaatgaatcacagctgagcacatttgaattttattgttaaatggaatgccgttaaatgtattatgtaatatccataaaagttcacactgattgttcacttttatgaacctctaggattaaaagtacgtctttgttaatgaagccagcaaaaaatggagaacatcaggaacaaagcggcatagctttgatcttgccttgatgcttctaaaaaaatatatacgtttgtaagtatatactccaattttcaatagtattttaatgaataatttttataaatagaggtaagagattagacacgttatctggaggtaataactaagtaaataaataacagctacgttgctctttttggaaaaagcataaaactcagccatctaagacaacatacttaaaaaagtaatagtctttgatacattcctcgtgtaggacaaaagcaaaaattctcttccgtttatttttcatgaaaaaagcttgtatcatatacacatatctatatatttgcatattattctttttcgttttttagaattagccatatgttctcgataatgagtaaacctctttcaattagcaacgtcctcctttgaagactcctttgaagccaaatgggcttccaaagatgcgattttttctcttaattctagattttcttttttggccaactgcagttcaatttgggtctcttttgatctgccatatgctaacatcttggccatttctttgttctcgtttgttaagttttctaatcttaccaccattttgtgagcaatcgattctgcatcatacctgccatacttagtcactgaatttgttggatttagcgccagtgcagttaatatactttccagattttctttcgtctctgctaactccttttcctttgcatgcagtgacgatgacagttttctgaatatcacttccaaggaagctggcaattcgaaagtttggggtatatggcagttttccttctcatacttatgctcattctgcttgtagtttagcccctcgttgaaaattttctttagcctttgaatttcgttctcgagtgattcgatttgactttcctttatttgtagttctacttccaatgcttccattctgtcatctttatttgaattcatctcattgctgttgacattattcattgagagcgctgtcacatgattaaaaggaacaaatgaattcttgaatgccgtactattgattgaggttttagcggtcatattagacattgatgacatcgagtcattaggattcccattagtatccttgttatttgtcatattattcattggatccagccaataatcattagcagttgccccattcatgatattgttatgattgagagtatttctcatagatgcttgtggtacattctggtaattataggtattcattgatgggggcatgttgaaatttgttgtactgttcaagctatgttgacccgttaagggactagccgacgaaccttgaggaagcatggaattattcattttactcgcctgacctaaggtgttcattaatcccggcctggcatcgtttctttcaccagattcgtatagggcttgttgctgtgactgttggtggggatgaaatgccaaattgttaaaggacgtttccaacgaatgttggggatcataatcataagccatgtaattcatttttacaacagtattccaaacgagccgtgtatgcaaaaagaatgaggtcaaatcaaaagatcaagtaccaagccagctgattctcttcttactaagtttgactatcgtttacatttcttgcttgttgtttcatcaaacaatgtactcttttcttgttttaaatgattttttagcggcgaaggtaacagcagcaaaaaaaaaaaagaaaaaacattgcaaaatagctaatggaaatggatttattactgaaatatgtagaaatatttaactcgatagatttgatcatacacatataatgcaaaatatatatatatatatatatatatatatatatatatatatgtgtgtgtgtgtgtgtgtgtgtgtgtaaacgttcttttagcatcttgtatagaaataaatataaccattttttttcatatcttcaatgctgtcggcagcaactagtttctcatcgttataaagaacccacttccatttgtctgccactagtttacgaataaaaacaacatagtgaccagaatggacagaatttcccttatgacaaataactgcagttaaagcgtacggtttagcggtcgaatatccaagatcctttttttgttgctgttcttcatttggcacttcaggttcgggaaatgttccatcatcatccatgttgttaaatacccattcaacactacgattaacatctccgttgttgagtatcaaggctttacgacataagttgggatttagtcccatggataacattgaagtcaatgatacctcatccacttctctcttatctttcttggggacattaggaggcgggacaaagggatcatttaaatcagggtcatccatatgctggaatagccaattcatagcgctctcagcgtcttggtttccggtgttaaatagggcgcgcacgctagcattttgagtaaagcccatttcaattaattgagaaatactgcattggtttggcgtaaaagagctacggttttcgtcctcatcaggcaataagttttcagtttgaggatcaaatccttgtgataaataagacgaaacatctagcatatcatccctgtctattaaacctggtaaagaaagctcattacttgtcttaacaggaatccagttctgtaatctaatccttattgggttcaaaataagtgtttgaggaagagatttgaaaccaggttttttatttgcggtaaccttttccttacaattagcacatttaaattcaatcgtctgcccttcaaaatacgccttgattctctctaacatatcttgaggttcatcattctcctctaagggaatctgtatagcctctgtgggttcataagaatatttaaccttcccgcaaatgttacattggagcctatcctccatcataaatctaactaaatcgttgggatttggaatacctgaagaactacttgaaaaaaatttcttgtctaacaagtctaaaaggaaggttagaaattccatcgcatcctgttgtctattggaactgaattcctgatgattttgcccaatgcatttcttgaaagtagtaggtttgataccatttggatatagttcgggttcacatttcatggcattgagtagcttgatccattggcactttaaattattgtccggatatacaacatccagtggaaatttacttcctagaaaatccaaggaccaattcgggacgccaccattcaccaagctttgtataaccgaatttaagtaacaggaattacccaaattgatcagaccacagccataattcttactagcggataatttttcaaattctttaccgctagaatcgaccattctaaattgccaattttcgttctgttccacttgtaattgaactagagtcttttcatccgcaatcttttcttgtatgttaattccgtatatttgtagtgcactgcctaaattaacattatctggaaatctagtttcgtcgtcacatgcgtaacaatacagatcataggttgaagagcttaaagaccctaatttgatagctaatgggtgattattattactccgataatgatccaaagcatgcgagtgaccatcaatcccgatttgttccctgccacatccgatattaccacaatgtaggcataaccagagattttgagtcaaatcacaggaagagcattggtttaaattcacagtattttcgggcttagatggaatttgaaagttttctgtatgtggacaggtgctgatttctaacacccaggagttcttcttatcctcgaagtcttgtgacttcgcctttaatatcttttcaatcttctccaaggccgtagaagaaatgtcagagtctgtcgacttcgaaagtacggtcctgggaacattttcaccattgaacctttgtaaactccaaatagtgttgtgggtgtcgtcttctgacgtctcaattacctgtagctttatttttttgttgttattattttcttctacattttcttgcttaggtttctccactttagcaatagttaaataattggaatgtatggtatcgcaagcatattctgtgactcggatatggagtggaacatgtctgttgcacgtagcttggaaacagtttaagcatatattcaatgaatgtttaggtgatgcattgagggccaatggttcattataaggggattcaaagcaataaatacactcatcttttgaaacgactgcaggaacgttaacgttttctagtactgcttctgccatttctgaatgtgagaaagacttcgggctctctttttggatgaatttacctgtcatctctactgccattgcaagtcgcttttcactgtgatttcatcaagtgataaatttgatctcattccaaacgatgtcatttttcaaaggcacatcaactgttataaattatatcctatagccacaagcaattattagtttatgtattgtgtgtatatttatgtaactctatcctccatgatatcctcctaaattttctgtccccttgcctccagcttatactattattaaccgaataaggatataaataatcattcaaaggaagcaatactttagtataccgaagaaactcaaactgaaaattgtgagaaaaaaaacatggaggaagaatgaatcaaaagaggccattaaataaaagggtaaatgtatgtagtaggtccaataaagcttttccaccacttcttcaatagtatttagtatgccttctgatttcccattacgtcttttagcttccttagtggtgggtatgtacaccatcgagcttttatgttgtgtcatttcttccccttatgatatgttccacctttgttcttccggtttctacactctttatctctagtacttttaaaatggtgtcatttctgtcaaattgcgagcactattactcttcacttaaccgcttctcgttaagcgcgtcaggagtaaacgtcatctcgcacgatatgcttaatgcatatgatttgagttactattgttctatcaatttagtttttgaggaagatatacggattgtctgcgcctctatatgtaacaatgtatgtatatgattttatatgtgctctatttatcgaatcatttctcgcttctaaagactgagaaaaaagatctccttttcccgttactgccaccactactggatgcactacttgccatcgcttcacgacggaccctttccaaatcaagcgattgacgggccctagcgaaggattttctcatctctgatggagttgaggtgctaatagtaatgctgctattgctatccttatccttcgaatgccggtatctttccaaatcgtgcctttgcttggaaccagtcctgtgtgtttcatgcttgccatttgaccgggttgacagttcgtgaccagtactgtggcgcttattctcagttattgcggtggaagcatgaggtgaaactctatacgagtgatgtgaatttggtgctggcgagtcgtttttatttctatgctcttgagttaacgttggtgaagacagatttacttcctggaaattcagatccaatgactgccgcggttgccttgttgatacgctgctgaagtccttgcttttgaattgattagacttactagcatcacttgatcttgcctggtctttatgacctctttcattatggagtggtcttctttcagctgtttttcctctccttgcatcatccaaatcaatatcaatgctttcgctggagaccatactatctcccaattcgtctgttgaataattgttcctcttactggaacctttgcgtccagaaagcttagcttgttgaattgatgcagacgatgaagacgatgaaaaggaggagacagcagcaccagtatcatctcttgataagtccatctcattcaaacttaaatttaaaacgccatttcgattattgttcgagcctttgatagttcctgaaccgccggcatcttcgataccgccagtttgaggctcatttgtatcttggaaagattgctttcctgcatcttcttttaatggagatagttcaattaagagagcttcatttttagaggatgagtgcattggttcatttgcagaatttcctgcaagaattggaggttcacccccctgagcatttctcatatcttctgtggtatgatttgttctatcagagacgtaagtaccattattatttgcattttgaatttgcatttgctgttggacttgcagttgttgctgaacttgcatctgctgcttggcttgcatctgttgctttgcctgcatctgttgtgcctgcaattgctgggcttgtatctgttgcgcttgctgctgattcatggaaataacaggtctcaccattggaattgctggggaattttgacttgggagatatcctgactgggagttcgtggcgtaattttgagaaatattctgaaagttgactcttctattaccactatctccagcaatagttccacccaactgcataggtttattggaccgatccctcccagtgtagaaatttctttggctataattagcaggtcctttgggttggtcctgttgttgctgctgttgttcaactctagattgatactgagattcatctggaaaggtattcccttgtgtacctgtttgattttgagcttgctgatatctctggccttgctgttgttcttccaggaaaaagttacttgcgtcattgctcaattcattcgtagaatggtatgcaacattcatttttggaaagggattattcgatttatgttgtttcatcttattaataccagcagttttctcgttcgccaaggcttcgtctgacccgatcgttgctgcaccatatgatgtgctcttcattgatctgccacctgaagaataagagcttgtgctcttttgcctctgtggtagtgattgggtattcaaacgaggactttgttcagaaatagtcggatcacttgattgtttgaccaattctttgtccaaataagtatctaattcgctcacgcttggataatataactctccaggagttttattttcaaaaattgatttgtcctctatacctggagactggattgtattgatttcttgaggattattggctgtaccagaactgttagcattcgatgttgttcttgacgatttatcttcggacagggtagacttcctctgatcggattgactttctttctcttcttcaagttcttggccgacattttgagatggtattctagaaacagcggcatgaccgtcactagcgttcatgggaagtttggatgagatttcaaaagaagaaagaaacatgtcattcagtaagttttcttctgagtcactcaatttattgttctgcataattttcttttgttgtagctggtacatttgcaattgaacattttgtaatttattctgaaactgcgtatatttagaaaaattataggcaccttccgcatacttatcctcgattggaacttccacatttaaaatctcacataaatggtataatacttgataaatgttcggtctcaaatttgggttttccgccaacatgataatgattaagttgattagttttgatgaatatttgttgacaggaaattcatatttggaatgtaatatagcaaattgacctgtcatttcaaaaggggtggtgaaaaataataatttgtaaaggaaaactcccaaagcccatatgtctgatttttcgttaatgggcagacatctgtaaaggtcaatcatttcaggggacctatactgcggagtagtatgcacatagatgttttgagtcaaaagagcaatatcttgatgagtagtgacaattgggaaacatgtcgacgtggacccaaaatcagctagcttgaaattgtttttggcatctaccaagacattttcaatcttgatatcgcgatggatcaaggacacaggaaggtagtgcatttgagagatagaaagagcaacgtcatacataattttcacaatttcagcttctgtcagtttcgttgacaatcgttggttcatataatctagcaaagatttgtttggacacaattccattagcaaaagaacctcaaatccttgaacgccatcacgacggcgagaggcgttggaatcgaagtattgtactatatttggggcccctttcaatttcttcattacctccacttcatttctcatctcgttcaatccattctcatcttgaactaatactcttttcagacatgcgacatcgccaatctttaagggaacacttgctgtattatcaaattcattaagatactctaggaatttcaccacgtaaatttgagcaaagccaccttctgctaaataatttaccacttcaactttatgtgtgcctacgcagacaatatggcctggagtgtacctctctaccgccggatggcccattgccgaaacgcttctagaagtaccattcgtgatcgacatgatcagtgctaattagaaagaaaataacaggcgacagggacgaaaacaagagcttgggaaaacgtaatagcaaaaaatgaatggcaactaaaattatctctatgatgtcctgtgttgcttatgctcccgaggcaccgattctgattcaacaatgctattgaatttactcattcaagaaagggggttcataggattatggcttttattcagtatttttaagttttttcggttattgagctctgaatagggcattttcagaatggcggggttcacctaaaaaaaatgaaaaacaaatataggtcataactcgtctgaattttcgaagagctcatcagacgtttttcagtagggttatatgagaagttttttagtcgttttaagatacatcactaagtattgttggttatgggaaagcaaagctagcaagcctagtactattacaattgttcgtgatatgtatacatttatagagtatttaaaacggttttcagaagtttttcaagttccgcatacgtgtagggtacccaaataatttccattccagaattgttcttagttatgttggccattttatgttctatgaattctctaagcatcgaccttagagctatctcattagaagcaataaaatcagcggcacagagatggttgaaaagtttaagttctactccagttctttgagtaccacgcttaggacctgtgttagcggatagattccccatattctgcatttgtgtttcaataagcaacttatacatcttcttggagttcacagtaagtgattgtaagacgtatttcgcaccttcagcaccactgctggtatcgcttttacccatcttcatcacatcttggaacgtagactcgactgtcgacggttcaaaattcgaaatatcatgaaagacaaagttgtagttttgggccttcatgttgtcccagaggagcggagcgtaaatgtggtctgtagaggcgactatggcgatttgtctgatgacggagaggaagcttagcatcgtctgaaaagtgtttttccttatgctaggaccatccagattatgcactacaagtattaatttgatatctaaaggttgatttttgtagaaatcaatcatcttttggatctgcaaaatcacatgattgccccagtacttagtttcgcttcttgtcaactcagcggggaccaaaagatcggtaatctctttgaagacgtcacgatagttacagctagggttgtaaccatttaaaataaggcatgggatggaatttacaggtttgttttgttgtaattcattctcataagccagttgcgagtacgcgattttcggagacaagtagtcaatggcaaactcttccaaaaaattacgtttcgaacctacaccataaaataataaggagaatccttgagtcaattcaaaccaatactggggaaacatttttttctgaatttcaaataacttttgcctgggacgtttttgaaaattttcgttgaaaaagtttgatactagggaaaactcttctctggtaacgtcaggtgccattgacatggtgtgccttgacttcgcattagttctgacaatttttctttggtcgaaatatccttcaaaagtatccaaaaacgagcttgctgacttggtttccgaagtttggtagagctttttatttttcggtacaggggttggagtaaaatttctactcaaggttaatttacctggggaggttgagtctttatattcttttaaattattcattataatttgctttaggggcgaagtaaaatcatgattagtggttaaagacttcttagatggtgttgcaggttctggtggctcgggtgaatttgatacaaaattatcatcagtttgtggagtcacattatcttcatatgttgtggtcgctacctgtattttttcgcgttctcttttctcttttatccccgtcttttccatcacctgcttgttgttagaagtcttgctttcctcattgacattacctgatgtatctttgtccaatttcctctttttcttagaggaaattgtatctttctcatccttcttgatcctatcagttaattcttcctgtatctttcttggtcttccacgtttacggggagctttacttggcgttttaggtttgagtgccggatctggagatgtatttttcctttcgttgcctacaagcgagattctttccaacaaattcttctttgatgaatgaattcttctcagttgtctttctccatgtgggtcaaccctttttggggttacattcctgctttttgccggagacgataggatatcattatgctctacaaagtcttccccatttagcatgttatggcaattcgcagtactacaaaaacttgttttaaagatatagcaaataagatcaatgatcaattatcaaatacaatttcagctaatatattctactttgtcttaatttaaaggtggttcctatttctttataacttttacacattgtgaagaataacaattctgcttactattgtcatttccacctcaatgatgcggtgagtgggtgttctgaaaaattttcccgattttgctagactagaaattggtactagctgatccatatcacatttacgcgaataagtcgatatttatgcatggatatttggccttttacgacacttattcttatgatccattgaaagatggttcatattacatataaaggtgccacagcaagttaatgtcacggcagctagtgacgctattgctagtttacacctagatgaggccactggagaaatggtctctaagacagagttgaagaagcgtattaagggaatacaaattgaggccaaaaagctgtcaaaaagactcttgcgaaaccaaaaccagcttcgaaaagactaatttcctggccggtttatagtcatctcaatactagatcacagcaaatccaattaagaaacagactcttgatataaatttttatccatacaagttccgattatatatattcaatcctgaatttttggccaagtatgcccattcaaaaaggcgaaaatttcccttaagagaagtttcacattgctaggagagttcatgcagaaagagaatcagcttaaaaattgaaattctacgttctcaatggtggtgttgagctctaaattattttacaatttcaggattattacgacgagaacccataaaaaggagcatgacctttaaggaggagtaatatatatccaccaaagaagaccggcggagatgagatatatttttttcgttaacagagtgcaattgacaacttgtttgcacttgcctgctaactgttttggtttcaaagatcaagaaaatagatagaacccgttttattattcaattgacatcgcccgttatatcagacgatttttggatcaaaaaaagtttattggagcagaagcaattctgaaatgaaggtcctaatatgaccccaatatgacacataattcggaatctgccacttgtgagttttatcaagcctatgcggatgtttgtgactagttggatatgactgaattaatactttcagaaatggacaaggagatatgtgattctctattatcaaataccatttgaaccttactggtccagctaaaaaagagctagaattcatctgttctagcccatggaagagaaccgatatgattggcagatagaaaccatactgattcgcgtcgtatctagcacaacccacgtaagaaccttaattgacgaacagtcaaaccttcttggcttttacaaccgagaggaaatactaagtcaacatcaaggtggcaaacacaattcacagtatctaatttttcgttatatcacattggaaaaagtattaacgtataatttccatctgctgagcacttgctgccgttgagaccggcgaatttttgaaagaagtgtatgccaataataaattggaaagcccattaaataatgctcttatgttggataagctttcttcggtggaataaaaggcacatgtatcaacctgactttcacttttacttaaccccaagctatgtctccattggccaggtactcaaaagaacaaccgggtttatgtgagcgtttcgaggtttttgtatctaaaaaggagatatgtaatgcgtaaacccgaactgaacaattcgtttgaccaaaaggggctttcctacaaacaagcagggcaataggagcaaggcaaatggatcaaggtgatgcttatgcataatttatacgatggaatcctttgtaatgctccgtactacggtttaccaccaaccggcttttgggttgtaatattgacagattcaccatgttctcaatggttctgtcacaattcgaaagttctattactcgcaaattcgaaagcagatgttttaagagacgaggtgaagtaaaaaagaagaaaaatgattgccatactcctcaatgcttgcatgtaatataatataatataattactgtttcattttcttttatattatacaatggatattctacataaccgtaacctatatcgtttttaatgattgcaaggaaaagttgattttgtagataatcttataatgtagtgacttatttaattgtttgattagaggtagtaatattgcaatcaaactgatctagtgagtttcccgctcctttttaattccaaagctttcttgtagggagggttcgtcgggctttgaacaggatctaaggacgatgaagtgcctgcaaccgaagaaggtaggtcatgataagtggcatctgagtcgaaactttgaagacttccacaagccataaattcggctatgtttctctcctcttcattccaatgagacaatttgtctgatatacacaatttattcaaaaaacagccttgaaaaaattcatcaacggatgtatttacatctaattttggtgtccaattggatggtgggttatagcctaaacaaacaataaaagcttccagagatgtacctcttgatgatcttggctttgcgcaaacgattttatcgaatagatagcccaattgggaatatagcatatctatatcacgacctctgaagatctttgccacaaaagttccaccttttttcagaatgcatgcagtaagttgcagcgcactcataattaactgttgttgcacgtattcgtcaagatcgtgtaacccagtaacatcaggtgcaccatcactacaaacaaaatcggccttttcgttgccaaacagttttagaatcctcgccaatgttttaggatgagtgatatcggcttgcaacgttgtcacatgaggtatgggggacatcggttgtaaatcgacagagacaattttcctgtcctccttatctgaactgggactttcatcaaacagttttctcgagagcacttgtgaccatgaacctggtgctgcacacaaatctacaactctttttaagtttggatcatccaggaaatgaaattggtcattgagttgaagtagtttgaaagcagatctagccctatagccctgctcttttgcttttctatagtacaaatctcttttatctttgctgctcttacccatcttgaatactttctttttaagcttgccttgtactcatctactgttgttttacagtaatgttaggagcatcgcttgaaaattttcaactcgcgataattattgttagcgcagaataataatacctagtaaaaagtttatcgttgcttttacttcatcatgataatcaaaatacttgtaggtctgtcttctgtgaaagaagacgtagttacctattctacttaggtttggtgtctttatataatataaaagaaagatattaaccgtacataccccaatcttcttccagttctgcttcagttgtatcaatctcattaatgattcggtggcccataacattatctctgcataatggacatgttgtacttcgagatagccagacagacaaacactctaagtcgaacttatgatggcaatgaggtaattcaactactaaggggtactcatcttctaaataattagtgtaacaaatggagcagttgtcagttgctttgagcttttttttattgattcgtggtaaagaggctgcaaaagtatcaggacagcccgcactcttgcctttatccatttcttgcaaccattcttcctgtaatgattctggaagcatttgcgataataatcgtaaaagtagtgttgaatctgaatgtgcatcaccctcaccactggtgttaccaaagttttgaaatagaccttgcagttgggatctgacctgtcttctctgctcctcctgtgaagttcctcctacttcttggtaatcccttgagttttgttgtattccatgttcctctaatctaatgatgagtgcagattaaaattcggttagttaattggctttggggaacttacttcataatatatcattacataccttcatatgtagacatttttttgattgtgattatgtttgatgaatatatctttctattatttctttagtagtttaggagtggcaaaactggtattataacgaactgagcgctcctcggtgcaaacaaaagccgcccacaacaattttgaccaacttaggcaaaatgaagccattactagaaaacgaagagtatatatcatcacagtaattcgggtaggagagttggtcaccaaaatgggactcatatggaaggcaaaaatttcgagcttattcatcatggttgtacccgtaaagtttttgtttccgatatatagagtacagatgttttctagttaacagttggcatatcttacattttccggattatgtatcaaataaactttatctatgaatagttagagtaccacagtagaatcgaagttgcgcctttatcattaactaacaatttttttgtgggaaccgaactattatgtctcctggaacaaatcttttgacttttaacccggagcaaattgcgaatccttgtcaaattttgaacttcatcatagcggataagatccttatgaatcacttcatctaatcgctctcgtttttctcggtatgctccagttatttcaattgggatgttgttatcaaagaaaactggtttttccatgaacatagtcaggaaaagttcgtcaccaaattggctttttataatcaaaaacgatttacagatatcacgaatttctctactcacagatttagtattatctcgagcagtgaagcttctcataattgaaatatttccaggcgcgtattgtctgccataatgggagagagatacatcgcatcccataggaactttaaccattgtttcgttaatacttttttcaatacctttaaacggcgtttcattcgcgctatcaagtaatgtattatttaccactgctttaaactcgggattcgagccaggtgatcgcgttaagacctctgttgtataatctttagttaataagtcgtactcatcaaaattgccataggtgaaattttcatcgctttggttcaaagttaccatattttgcctaccaatgctgagaactgactcctttgaatgtaaaactgtggattcctcataatttctctcttcggtaacgtcacttcgattattgaggcagtcttcattaaagtttattacaatggatatggtatcaccagtcttgaacctacaatcatctattttaggtgagctcgtaggcattattggaaaagtgttctttctcttaatagaagagattaaatacccgataatcacacccaaaattattgtggatgcccagatatcttcttggtcattgttttttttcgcttcaatctgtaatctctctgcaaaatttcgggagccaatagtgacaacatcgtcaataataagtttgatggaatcggaaaaagatcttaaaaatgtaaatgagtatttccaaataatggccaaaatgctctttatattggaaaataaaatagttgtttcgctcttcgtagtatttaacatttccgttcttatcattgtaaagtctgagccatattcatatggaaaagtgctttttaaacctagttcctccatattttagttttttatcgatattggaaaaaaaagagctatcagaaatcagtcaatatatcatgtacctatggaaccttatctttctcaaaataataaattatagtgatacttttagaattgtgtcactttctttttatttgtacttacaaaattcggccgagttatcatctcggtaaccgagaggaagagcccgagcagctaaaagcgacaaaccgtacagataaaatgttcgtgctaatccaaactgcagcattccgtataaatttgtcagatatactgatcaacttagataaagttccccactcaacctgcttttgtttattacttgcaaggtagatggatggtcgaaattgatcaaacagttcgtttcttcaacccatgatttttcttacgtttcatctatattgttaacttgttagcgcgaggtttcgatttctttgatctgtccttatgaactttttttgatgtctttttcttgtcattctttgcgttatctgtgctttttgtaggaaaagaaagccctagctccaactgaataagcttattcaaacttaaactaagttttatattttctgcagtgttggttccgaatgacgcagctgaaaagccagacgaccacggaatgataaagattctaaaacggtcaataagtaaaactcctctctttaggccctttggtgtgacaagtgtctcacttattttactgacaaaccgctcccccaattcactagattgaaatcttaggccaccacacttcgccttgtggttgactattaatgacaatgaatttccatccttccatttctttatacccaataattgcgaaactgtatcagttattttccattcagggatcgaggcatcaatattatacagaaaaaatgatttggtggaggggttttttaaaaacgattcattcaagggtagtttcttcaaaatatgagaaatgtccacggacgcgtacttttccaagtttttgacctcatttgcacctttttcatttttatacaatgcagttgtgttttttattaacggagtacttgggccatctgatgttgctcgcagaagtatatttttcaatttatcaacgatattatctgcttctgacggatcactcgtaatctgagctcctcctaatttcacgttttttagtgacagaaaccttttcatcatgtcgttttttgcttcctccgtcataacgttttcctcgttcacaagggatattaaatgatcccgcagttgtatagggatgtgccatcttgaatcaagcatacagcattgacaaatgtttctctgagtggcgcaccgtacacatattaatgttttaatgatattattgcttcgtttagacgtcttaaaatggtataaggtgaacggtaaggtacaaatcttacattcagagccttgtggaattttagtcattcgtatattagcctcatcacctaagcactgctcacatatattgggcggtggctcattaatttcatcattcattatattaagggtgcaataactcttttccgttagctaccttctattcacctgctcaaaagcccttccatcatcattaccacttctatcaataaaatttgccatagcatttcttttttttttttttagtccttattgcctaaacgtcatcacaggagagggtaatcccggaatgaataaggtttgaaacttcacgtccctccgggttgtgacttaaaaaaattacgaaagagaaccgactatcgttcctgctattgttcttggtgagtattactaacccgcttagttttattactatttatcagtcttttatttgtacgttatttgaatatttaaatgtttttggctgagctcactcacatcaactgctagcctccctcctcttccagtttcttttcttcttgtttgcatgagttcgataatgctgattacagttatcatgtctactaaacctctgtccacagccctcatgcggacagatatgatttttttcacctgtatggattctgttatgtcttgaaagatgaccagaagtggtgaacccagtagagcagatcttacagaaatgacgagtcctctgtcctgctgtattggttttcgtagatttcaattttatcacggtttttgtcggtttgcttattttaattgagctatatggatctgatttaccgttaccggtattctctgcttttacaatattaatattttgcaatggcagtatcggtgacgtttttccacttgctgttaatcttgaaatagtcccgtcactcgttctgttcgcttgttttccggagaaaaaatcgaaagcgcacttattcaatttatctttcaagtcatcatcaattagatgtgatgttttcatcaagggtatcagggtttggtatttcctttcattgttaaaagagaacatttcaggcataagagttatctgggagggcgaacattcgaaattgatgggaaattcacatttcctatctttagctagaatagttgacatcaagttgtctttgtaacctatggacatctggaaattttgtagaagctttatattttttgttcttcgaacagtagcgagtgctcatatgacttggtgccggaaactcatttgagctgtcataatatgataaatatttatatgtaaaaatttaggccagataatatataaaagataaacgatttaaagagggtgtaggatttgcctgttagcgatgtaggagctactgcacgatgtagcatgtaatagccagacgtgattcccctaaactcaggcccttctccaaggagaatgcaacggtaggcagttcgtttgaaattgaaacttttctcaacgacaatgatgtcccgcagcataagaaaacatgagatcagaaaagcgttgcaaaacgcagaagccacttatcaagagctacggctgcgcgtttttctgggacgtgctgacaaacgagaaaaaagatggctttgtattcagttcaaggccctgtgtatttttttccttcaagaaatttttattttggcctggggtctttaaacggacgggtgccctgagagtactctcgcataatccagggatggctttttcacagtcgtttaacattcgtttatgaagtaaagaaaaaaaataccaaaccccgttaaaagagaaaaaaggtagccgaacattgaagcagcccatgccagtttgtccttgggcagatagttttccgtctggcttgaaaggttatagtctcctttttttcttggcttcgggaaaatacgatttgtttgttattctatatgcagagccgctgctctgcagggatttatgatctcgagtgccattgatcttgaagcatcttttgttgaaaggatttgtatgacatcatacccgaacttttttagcacgtgaaaatggagaagtctatggttttagaggttgctattaaggcattttctaaacttgagggttgtttgatcttatgttggttggttgtaagccagccggtgtagccacgtgttaaatcttgactttttttcccgaagagggtctggtcctgtctattttgtttcatgcatattttttctcaaggagaaagactcttcgctgcgccttggcataataacgtcttcggtagggtccatttttttaacgttggcgatgcccatatttagctcgtttggtcgttccttcgaaagataatcgttcgtaaattaaaaataaaagagagtagttttcgagcaacgagtagccagctggtgccaattgtcaagaaaggaaacatttcttacggattgggaagaagcactaatctcgaaaaagagaacgtttttagaaagttttagaagttgattatattaatgaagaaaaaattttcgaactaacaattacataaagagaaggtataataatggaggtaatttttcaaatatttgttgtaaaaggttcccttttataacaataaagcagctgcacctgcaacaacagcaccgaaagaggcagcgcctgcattgactctttgaccggcattggaagcagtttcgactgtagaagtgctgacagaagaggtagttggagcgacagaagaagaaacggccttagaagatgattcggcagatgatgatggggcagcagaagaagatggggcagcagaagaggatggagcggcagaggatgtagcttcggaagaagatgcagccttggaagaagatgcagcctcggaagaagatgcagcctcggaagaagctggggaaacggaggcaagagcagcagcgatttcagaactcaatcttgtggtgtaccatggcaatttaacaattgtcttagtgatagcatcaaagtccaattcactaaacaaggtagtgtaagcgtcatcggtgtaagtcatgacttgttgatacacactcaagacatcagatggaatttggaatccactgttgccagtttctagacccaagtagtcagaaagatgagagttgatgtcaccgataatagcttgcaattcagcagtttcggcggcgctggtgtcagcgacggccaaagaggcaatggcacttaaaacgaaagcaatcttggaaacggacattttattttatttagcagagggtatagttatgcaatagcaattattgttactgattgaatgcctttataatttcggtccgaacaaagttaggcaagcgagaataattgacgtttgaaagagggctgccaatgtactatttatattaaatggtgaatgaagcaacgcagtacctcaaagaggttggagacatattcacccttacagcaaaccttttttttcctttactggaaatagctcgaagaattggagagaaaaaaagatgcttttagaaaataagacacatttcccggaacaatcaattatttccatcacaatctttgaaagaaagggccaaaccgccgcaataactgccgtaggattcaaaaccacaagtacattcttcaacggaaaagagtcggaaaatcggaaaagggacctcccgaagacattagtctcataattaaggttatagtcaagaaaaaccataaccagatcgtctgatgctctttttgggaatattgattacccaataaggtcattactccaatttgttgggctccattgtgttgagtatcggttgcttgggttttgaaaatcttgctgccgtccggctgcatgtgtgcgccgcaagtgccgagaaagtaattatcaatgtggatcgcaagccaagacaataaatttgttgtttctgtgactatttcatgatggcctcctagtcaaaataccaagaagaagaaaggtttttttttctttttttccctacctggccattcaaaggtgaaatatcctttccattacccaaagaggtagtactgtttaggcggggtttgacaggcgctggaagggataggcaagaataggaacggtttccaaagccatagaaattcctccttcacgttctgttgaagggaggataaagcaaaatttgaaacaataacgacattgtgcgggtatgtatgctacggatgattaatgaatgtatgtaaaaaaaatataaaattacagaaacgaataaggtcattaagggaggggagggcacaagcaaatgtgcttgtgaagtcatacctactcagcgctaaggacatgccgtgatatcatcaaccggctctaatgggaagtgtccagacctgagtggtgtagttaagtttaacaccagaaatgataagcttttctcatcaaagacatattccttagtttttctttattttcttcgtcctcttgtctcattagctctggatcataaatgcgtctgtggaagtcaaggtcaatcttgtcgaggggatttaatagcgtaaaatctcggttgtaaaccatatatccgaagtaaaaggccaaccatattggaaaagctaaataattttgaaagaaggattccgcatcgcatttgcccccattacctaagggggccaatgctacccaaaattgggcaacaaagactaaaatattaaaaaagacaccgtatatggaaccccaaatccctgttgtggccttgtatcccaactcgtctagagaccttccctgtactttcattgcttgtctgaatcgcagatgggacaacattatggaagtccatgtgaataattcactcaagcctgcgatagctgctaaccatgtaaacacgatctcttcctttgatgaagctgcaacaaaagcaatgacgccgaaaacgcaacacacaataagagctctcaagggcctgccctctctgtcaacgtaatctaaaaacttgggtgcgtagccttgttgggccaaagagcaaatcagtcttggaccagcatacaaagaggaatttgccactgaaaccacagaaatcaaaataacagcgttgataatatgtggaacaattttcacaccgtgaatagaagcggctaagacatagggagatgcatgtgtagcggatccgcctgcgcccattagttggtcatcattatatggaacattgaatccaatgaggatcatagtcaaaagataaatcacaacgatacgataaatgcttctcttggctgccaccggagtagattttctagggttagactgttcctgaacacttagtgcaaataattccataccaccaaaggagaagtaagcagtaactaaaatatagcaaacgtttttgaacctaccaatcgatgtgtcacctgcaaaagcacctggattatgccaataagtggccccgatataaccgtcatttccggccccaccacagttgataacaatagaaagaataatgaaacctgcaatcattaaaattttacagcaattgaagatgaattccgtttcaccataggcttttacaccgaagaaatgaatgaatactaagaaaacatagaaaataagaatataaatgtccggatttattttatcattcccaaattgaatagtcatagacgcggttattaactctaaaggcaaaaccgttagccattggaaacagtaaagccatactgtggcgaatccaaatgatttggaaatgaatatggaggagtatgcgttgaaatttgctggtaaagtcggataggttaccgccatctcacctgcagcttggatcatgaagtacgtctcgaaagaaaccaagatgtaaccaattattagcgcagcaggaccaccgtaatgtagaccttttgcattagctaccaaaagaccagtcccaatacctgtccctaaagacatcatgacaacatggcgcgacttcatggactttttcaacttggaatccgacgtgatagactcaacgccatcctctaaatcagacgtattttcatttatttgcttagttcttgtagtgctaccctcggctcttttgaatgaatccgcaaatctatgtataagtttgtcactcccggatttttgcttagaataagttttctcacttgatgatgattggaaattattcccggcactaaaggaacgtatcgatatcgaatcaggagaagtttcctttttcccagaagatccaaaatcttctgaagatagcatttctaaaatcacttgagttttattgaagctaaataaattgatagtatcgaaaaaggaccttcgtttcaacactagctagagatagtaataatctaatggcaaaatagccattatacgtacctaatatatacgtatatatacgaggagatgtgctcatcaaagaagtggcatttcaccctgaaattttttttctttttctcgctgaagagtcattcctagtaaagcatgctacttttcagtatattccattatatttttaactacaagcggcgcagaaaccagaggatcagccactgctagcagcatttgctgctgacatatttaccgttgaaggccatcataaggcagtgttctgcggggagttggaatgtggatgccggttccggtcccacaaaatatgagccgtgagaagcggcacataatgcagcgtgcggcagtgtcagtagcctccttatactcctagatcgaaaaaagggcttttctttttgcggcaccccaaagacagcatttcttttctgtcaattacgcgccgtgtcgccgtttcttttcttggcacatttacacacttagtccgtttctttttttgcgcgttatattctgctatgttttttcgttggtttatatgatgagtaatcaaactcatccatcagtctgcaacattagtaggtgcaaggtggaagctttgtgcgcacaacatgtttgattgcaaagatttttagtagaaataaaactactcttaacagacttaaaaatttaatttaattatgcagatttgtcctttctcgacttgcattaatgctaaaaaacaaatatatattttgttatcctgaagagtggcaacgaaagcccgatgaagccaagcggaaaatgaatggaattgctgttagcaccagaaattggtcatcctcttaaaaaactttcttgaacgcgagctgtttggattttccgacgattctgaattttcatactctttaagatcatcgttatcgtcaactttgtcgatctctgtaagcgatggagacacaaatatgtttctatgtgagtccaaatcaattttttcggctggaatccaaaagctccatgatttgaagtatatcttgtgaccaaaataggcaaacaaaacgatgggcattgccaaataattttggaaaaacactttgacgttaagttttccatgttcattaacaggtgcgatggctacccagaactggcacacaaggaagaagattgcaattaaaactgcaagccatgaaccccaatagccagtttgtgctttgtatccaacttcgttcatcgaacgaccttgctttgccatggcatctctaaatcttatatgtgacaaggacattgacatccagataaataattgcgaaagactagaaattgccaataaccaggtgaaaacctgttcttcagcgtcactagtggctacaaacccaatgcatccaaagacaagggaaacaaaaaaacaaagtaaaggcctgccgtttctatcaacatatgctaagcatttaggtaagacgccttgttctgccaatgataataacaatcttggcccagaatataacgaagagtttgcaacagaaatgacagaaatcaaaataacagcatttataaagtgaggcacaactttgacaccatgtgatgcaacagcaatgacaaatggggaggcatgggatccagaggagtcactagaccctaataattcgtcactgttgtatggaacaagaaagcaaaccaaaatggtggtgagcatgtaaatcagcagaatacggtataccacttttttgcaggcattgggaatagattttgttgggttttcctgctcagcggcagatagaagtagaacttcaattccaccgtagctgaatgcagcataacagaaaaccgtacatacacctttgaaaccgtgggcaaatggaccaggattgtgccagtactcagcaccgatgtatcttctgtcacctgcaccaccacaattgatgataatcgccagaatgacgaatccgattaccatcaatatcttacaggaattgaaaatgaactcggcttcagcatagcctctggacccaaatagattaatgataattacaaaaacgaaaaccacggcaacaaagatgtctgcatttacactcgtccagtacttaactgtcattgccgcagtgaccaattgtaagggcagaacagttagccattgaatggtgtaaaccacagaaactgcaaaacccaacgaagggtcgactaaaatagaaggatatctggtgtaattgccggttagtcctgcataacagagacctaactcgcctgccgcttggatgatacagtaaagcatgatcgatgctattccgtaaccaaggactaacccggcaggaccagctgttcccagcacctgaccattaccgaccagtaaaccagtacctataccggtaccgagactgatcatgactaagtgacgagatttgatcgactttgtcaggttgtttttttcttgggactctagttcggaattacggtctggtggcagctgccttttaaaagagtcgaagaattctttgcatttcctctgtaatatggatttgctgtccgtccttcgaggctccgctgtttgtccagatacctcatcttgtttttctgttattgtaaagtctctcttttgtttttcactgtgtgttctttcatgcaaactgtgcgaatattgtgctggactggcctctttggcaatgaaactgacactatcgtccatttttacgcctttttatcgagaaactatattaggtagctacggtggtaaaggcaccttataatacagcttggttctatgtattaatttcagactattttatggtctgcttttttttacggtcagagaaaagatgaaatagatgccacaaaacagggatatatacgaaaacagcatcttatatacttttttactccaacattaatttccaaaacaggtgagatgaggtaacccattcgaaaaatttaaatgttcagacactgtcaagttaaagaatataacctggaggttttcttttctttttgtccatcaaaatgcactttttttgaaaaaaaatgccttgtcaagataatgtgaagtttactggaagggccctttcctcatcgggttgccggccctgactgaccttttttgtatttttggccgtcccggcgcggcgaagagtgagacgacaccaaatagccgtacggcaataatcctcgtgcaaaaatctctaagaccggtgtcgcattatcctttacacaccaaatttggtgccgtaatgcattatgcatacactgtgcaattatgcagacatgaaatgtgattgtttgctttgtatacgtagtaattgtaagtaagtgatttactgatttactttctggttagcagtggtagttttaatgcgttggccggattgtttatattttgtgaagcaatcctggaaattttaagcatcaaagaaggtgcggtgccaccataagacttcaaaaatagttggaagttttactatcctacataaatggtttacttaaacaaggatgccgaaccacttggatcttggtaaataattgtccctcaattcttgccactggacaatgaattcatccactacccaatataatatttttccggtcagactaggagtattaatccttgccagcgattctacataaactatatgggaggaacccaacaggggcaaaagaagttccataattttcaaccaaaaggatattatacagcatgttccaggcccattcaataaaaacagatgaggggaaccacacatagcaaatctgattctaaccacgtgcacaaaagattgtaccaacgttccaatgatggtctttacactttgtaggagagtcgctttaacttccctagctttcatgaattcatagtattttactttgcaatgaccaaatttttttataaagtgggcgaatctttgcctggaagcctcatcagaataacccaagtacacaatcgacttacccagtaaaagatcctggtaattttctagaagacggatcatttcaccagtatgacctcccgatcctaagaatacaaaaatcttgagcggtttctttgacgattttcgtattttcagtaggttaactccatctttcgtatccttttctgtacctgcttgagtgtggaaaaaaggcagaatcgctatcaacctaataacatatgctgtcgatacgatgagcaccaatgacgccaagtaggccgttttcatgatcttcaagtcacttctttcgactttcctgatacaataataaaccgccgattacagttattgcgggcccttgtacatgaaatattaggatggcttcgctaagaacatttttgcttctggacagacagaacacgtaaaaaaagaaacacgaaattacgactaactttcgcgtaggggtaaaattacctaatgcgcgtaattaaaaaaaaaagcacagcagtgtaaattggagcaataggagaaaatgacctgtaaaggaagtattcgaattcactagtgcggatattaatagaattcataatttcgcgcttggctgctcattatattcttgactatttgccaaactgttataaagaagcctcaatattcgtttggtttattgttaaagaaggcgcaagctcggcacgagaaatatacgacgataaagaacataccaactatatattgtgacggcacaaaaagacaaaatacgtaaaatgctaagacgctctaaaaattccagcactaacacaaacgcagacaccaagaaaagacaatccatgcatttaggatccaaaagttcgctaatctcgctgactagcgaatttggccatggacactccaagacgaagcagaaaaaggaggagggcacagctccttctcaattcctgtctcctacgaataagagaagcacatctagtcagtcaaagttaaaaaggagcagcttgttactggacgaaacactgcttaaagactaccactcggccatgaggcacatgcaaacaaacgctgcaaaggaagaaaagctgcggatggctccatcaccaacgcagtcaacgaggagcgaatcagacgccagtctttcctccaccaagagctcgatctcttccatattttcccaagataatgactattccattcacgatttgttgtacgaagatattgaagagatggataaaacagacgctttcaaaattaacaacacaatagcaatcgatgattctaaagctctctttgtcttctgttcaaacgactcctcctcaaggacagcgtctatcgaaacattgcacgaatcaaatttggacaacctggatatgggttccagtagaaggacatcgttggactttttttaatataacctaccataggacacactttgttgttgatgttggacaattcgttaattaagagtccctaaacggctctactagttccaacctcactttgttttttcatttttttatgttttttctagaaccttctttacgtgattctcgctcggaatccgtcaatagaatgttttcagtctccgtttcaatattctgcgcacatcaatcattttcttactacatacactaacattactcctagtttaatttaattgaatttttaactttcttttcttttcatttggcaatttggctccttgaaaacaagactatgggtctctctcataagcctcagggggggaccccaaaaaaataacgcggccatcttgcatgcaccgttgaacctgtagcttacagtaagccacaattctcttaccttcttggcaatgtggcacaaaataatctggttatgtgtcttcatttggtaatcactgggatgttactggggcagcagcaactccgtgtgtacccctaactccgtgtgtacccctaaagaaccttgcctgtcaaggtgcattgttggatcggaatagtaaccgtctttacatgaacatccacaaccaacgaaagtgctttttcaagcattgcttgatttctagaaagatcgatggttattccctcccccttatgcgtccaaaaatatagggtgctcgtaacagtaaggtattcgcacttagcgtgctcgcaacacaaaattaagtaatatgcgagttttagatgtccttgcggatctatgcacgttcttgagtggtatttcataacaacggttctttttcacccttattcctaaacatataaataggacctccattagttagagatctgtttttaatccattcacctttcattctactctcttatactaataaaaccaccgataaagatatatcagatctctattaaaacaggtatccaaaaaagcaaacaaacaaactaaacaaattaacatgtcatttaacagtccattttttgatttctttgacaacatcaacaacgaagttgatgcctttaacagattgctgggtgaaggcggcttaagaggctacgcaccaagacgtcagttagcaaacacacccgcaaaggattctactggcaaggaagttgctagaccaaataactatgctggcgctctttatgatcccagagatgaaaccttagatgattggttcgacaatgacttgtccctgttcccatctggtttcggtttccctagaagtgtcgcagttccagttgatattttggaccatgacaacaactacgagttgaaagtcgtggttcctggtgtcaaaagcaagaaggacattgatattgagtaccatcaaaacaagaaccaaattttggtttctggtgaaattccatctaccttgaatgaagagagtaaagacaaggtcaaggtcaaggagagcagctctggtaagttcaagagagtcatcactttgccagactacccaggtgtggatgcagacaacattaaagcagactacgcaaatggtgttttgacattaacagttccaaaattgaagcctcagaaggatggtaagaaccacgtcaagaagattgaggtttcttctcaagaatcgtggggtaactaaagtgacctggctctatagtgttgtccctctcgcgaggaccattgttgcttgcatatggcttgaaacatatgtcatcacatctgagcgattttacctcttagaattagtttagatatatatgagttgatgaataaatagttataaaaacttgctttggcttcgatatatgaccgttatttttgactaagttttaacgaaggaatctaacctcgttcttgtaattaccaaaatcttcaacaacgcgctgttggaggtatctctatggatgtggcttgaaatatggatgtcttgcctacttctacttctgggaaaggcatttttactcgatcgcgttaatatatgcatcaagaaaataaaaaataaaacgcgaagagctaaaaaaaaaaaagaaaacctactataaataaccgattagaatcgagtttttgtattgaaatggcggtaataagcgttaaacctcgacgaagagagaagatcctacaggaggtaaaaaacagctcggtatatcaaacggtatttgattccggtactactcaaatgcagataccgaaatatgagaacaagccattcaagcctccaagaagggttggatcaaataagtacacacaactcaaaccaaccgccactgcagtcacaacagcccctatatctaaagccaaagttactgtcaacttgaaaagaagcatttcggcgggacctactttaaatcttgccaagaagccgaataatctgtcctcaaatgaaaacactagatattttactatcatgtacaggaagcctactaccaaaaagcacaagacttggagtggtgatggctacgctaccttaaaagccagtagcgataagttatgcttttataacgaagcagggaaatttcttgggtcaagtatgctaccaagtgattcagattctctcttcgaaactcttttcaaagcaggctccaatgaagtacaattggattacgaattgaaggaaaatgcagaaatacgtagcgccaaagaagccttatcacaaaacatgggaaatcccagcccaccgaccacaagcacaacagaaacagtgccttctacgaagaatgacggtggcaaataccaaatgcctctgtctcagctgttttcactaaacactgtgaaaagattcaaatcagtaacaaagcaaacaaatgaacacatgaccacagtacctaaaaccagtcaaaattccaaagccaaaaaatattatccagtatttgatgtcaacaaaatcgataatcctatagtaatgaacaaaaatgcagccgctgaagttgacgtaattgttgatccattactgggcaaattcttgcgccctcatcagagggaaggggtgaagttcatgtatgattgcttaatgggcttggcaagaccaactattgaaaatccggatatcgattgtactactaaaagtttagtgttagaaaatgactcagatattagtggatgccttttggctgatgatatgggtttaggtaaaacactaatgagtataactttgatttggacattaattaggcaaactccttttgcatcaaaagtttcatgttcgcaatcaggcataccattaactggactttgtaagaagattttagtcgtttgtcccgttactttaataggaaattggaaaagagaatttggaaaatggttaaatttgtcaagaataggtgttttgacattaagctcaaggaattctcctgatatggataaaatggctgtcagaaattttttaaaagtgcaacgaacttatcaagtcttgattattggctacgaaaaactcttgagtgtttctgaagaattagagaaaaataaacatttgattgacatgctggtgtgtgacgaaggccatcgactaaaaaacggggcttctaaaattttaaatacgctgaagagtttagacataagaaggaagcttttgcttacgggaactcctatacaaaatgatcttaatgagtttttcactattatagatttcataaacccaggaatccttggaagcttcgcttctttcaaaagaagattcattatccctataactagagccagagacactgcaaacagatacaacgaagaattgttggaaaagggggaagaaaggtcaaaagagatgatagaaattacgaaaagatttattttgagacgaacaaatgcgattttagaaaagtaccttcctccaaagacggatataattttattctgtaaaccatacagccaacagatattggcattcaaagatattttgcagggcgcacgtttagattttggacaattgacgttcagttcttcgctaggactaataacattactgaaaaaggtttgtaactctcctggattggttggctcagatccctattacaaatcacatataaaggatacccaatctcaggacagctatagtcgttctttgaactctggtaagttaaaggtattaatgacattactagaaggtattaggaagggtaccaaggagaaggtcgtcgtagtgtctaactacactcaaacattggatataattgaaaatttgatgaatatggctgggatgtcacattgcagactcgacggttccatacctgctaaacaaagggactctatcgtcacatctttcaatcggaatccagccatatttggattcttgttgagtgcaaaatcgggaggtgtaggattgaatctagtcggtcgttcgcgacttattttatttgataatgattggaatccttcagtagatttgcaagcgatgtcacgaattcatagagatggtcaaaaaaagccgtgcttcatatatagacttgtcacaactgggtgtatcgatgagaaaatattgcaaaggcaattaatgaagaacagtttgagccaaaaatttctaggtgactcggagatgagaaataaagaatcttctaatgatgatcttttcaataaagaggacttgaaggacctgttttctgtccatacagataccaagagtaacacacatgacttaatttgttcttgcgatggtttaggtgaggaaattgaatatcctgaaacaaatcaacagcagaacaccgtagagctgagaaagcgtagcactacgacatggacaagtgcgctggatttacaaaagaaaatgaatgaagcagccaccaacgatgatgccaaaaagtcacaatacattaggcaatgtctcgttcattataagcatatcgatccagcaagacaagatgaattatttgatgaggttatcacagattcgttcaccgaattgaaagatagtattacctttgcgtttgtaaagcccggcgagatatgtctcagagaacaatgacgccaaatatggacacttatatactaaataaaatagctattatttaatcactgattgtatttaataggtttattcttgcacgactcattcaggttcaagtcacatattaagtagggcctattgctgattcaagttgatatccacgttttcactaatttgataacgatacgctgcgggcgcaaatcaaacatctgaaagatttgaatagcctttagtcccaaaaaaaaaaaaaaaaaaataatgtgaaaaattatctacaaggaaataaattgataggtaaagttaaagaatcacggcatgaaattaaaaagtgtattcagatcagttctaaagtaccggaaaacaaatttgagtttgcttctattaatcacctattcgattattacgttactctatatctttgatcatgaacgttataaactcaatctaccaaaagaggatgagcaccctgaattcaatgacttattagaaacagcatggggggacttacagattatcacggcctcttttcatccgtacacgtccaaagaaaatgataaagtacatgattacttgctcaaaagggttcttgaaattacagggaattcttcgtttgcaagtgtttcagatgacaaagaaagcgagagatccatattatttcagcaacaagatcctttcaatgagtcatctaggttttcgagagtgacatattttgaatcttctaatatattagttaagcttgagggtaaaaatcctgaggaagaagggttacttctttcagctcatttcgactctgtacccacaggatatggagctaccgatgacggcatgggtgtagtgtctttactagcgaacctcaagtaccatataaagcacagaccgaacaggactttaattttcaactttaataataatgaagagtttggcctactaggtgcatcaacttattttgatcactcatggtctaatttaaccaagtatgtgataaatttagagggaactggtgctggtggtaaagctgtactgttccgaacttcagatacttcaacagcaagaatataccaacagtctgttaaggaaaatccatttggtaactctatctaccagcaaggtttttatagcagatatgtcaggagtgagacagactacaagatttacgaagaaaatggcatgagaggctgggatgtcgcattctacaaaccgagaaacctttatcataccataaaggattcaatacaatatacctccaaggcatctttatggcatatgctacatacttccttacaattaagtgcatatgtggcttctaattcattggatacagctgaccaaacgccggcttgttattttgattttatcggtttgaagtttttcgttataagcgctaaaacgcttttctattggaactgcatatttctattagtttcacccgttgtggccattggcttgtatttaatttctcgtgatagaatgacttggaaatcttattcatggctatcgtggacacgctttcctctttcattagccgctggtattattgtccaaaagcttttctctaacgacataattcgttccaatcctttgacgttctcaaggaactacttttggcctatctcggcttttttcactcaagtaatttttaccagttatgttctgattaattgctccaatttttttttcccctgtgccgatatgaaaagcctatcaattatcgaattgttcattattttatggaccattttactttttacgtcgaagttattgtatagttccgactataggtataccgggctttatcctctctcgattttctttcttctgagcacaatagctgctatattgagactacttgcactagcgttgggaatgagaacaaggaagaggcttggtagagaatgtagggaccatcactccaattacagctcccattctcaaatagatatggaacgagacggtcaggaaaacttggaacaaccccaagatcaacttacatcgtcacaagacgatcaagcaagtatccaagatgataatgtgtcaactacttcagctggcccatcacataatgttgacgaggatcatggtatggattcatcgtcacaacaacatgatgaaagggtaccattactgaaggggtctaatagcatggaggaaggattgagtactagagaaaattctctaaaacttgagtataccgattatgcctggatcattcaatttttgctaattgtaccaataccatcatttattttgtttaacagtgtggatgttatcatggacgcactaaaccatactgtccaggaaggaagtaaggctacatttgatgtactcaggttcggaatggtgggcagtattttgatcgcgctaccaattttaccttttttctataaggtcaactatatcacaatttctttaactgcactgcttttcttgatttccgcatccaaaacgctcctagtgcacccctttaccaatagtaacccattaaaagtaaggttttctcaaaatattgatttgtctcaagggaacgctgccagtgtacatgtccttggaagagaaggaaattttttaaaacctatgctgcaagatttaccaagtataaaatatagctctacacatattaactgtacttccgtaaccaatggaatggaactttgtatgtatgatggaatgcaacctaatttattgagcacgaatggaaatacgaacatcagcagtatggtcaaggttcatgttttacataataaccgaaactcaacagagagatctccttacgaaccaatagttgcagagttacttttggaggtgaaggagttcagggcttgcactttaacttttgaaagtagacatcaggcgaagtcacctgtcagagaaatcacggtatatcaaaagaaaaattcggccccacagaaagctaatatcacgaagacgatcaagtctgcttctggcataaacgaactgcaattgcataaacttgatttcgatcaggaaacttaccatatcggagtccagtggtttccaaaacttttgacggatggaaatgtagaggatgacaagttggggacaaaagacgaactgtctgtttctattagctgttattggggagaatatgattcggaatcggttgtaaatggtaccgctgttaggaaaattccagcatttgatgaattgataaattacgcacctctaagtttttcctttaccaacgaacagaaaggattagttattgtcaaggatgctataattttataattctaattagttttaaatgtaaatttttataaactcaaattcgcctactgggggagttgtccaaaggcttcgcttcttcccacaagaagaacaaaataataaaaaatattttgagaaatttttcgtaacaaaaggaaaaactattgagtttaacttatgaatgtactttactggccaagaatccgtctggaaccattctacggtgctctcttcgtagcgctaaagacagctatagtggatattcagacggtattgaaaatcactaatgatatcagttaacaaagtaagaaacatgtttcgtcagataagttctacactgctgcaagtgcatacaatgctcgtttttataaagtcctaaattatataaccctccagtaactattagaaaatagcacgcaataatgctagcgatatacaaataacctgtaaatctatatatttattaagtataaagataatggtcttggaaatggttcttcagggattgtgattgactatagccggatatcgtttggatcaagagcttggttaagcggatatttaagttattttaatatatcgctttgtccaaaagcaagttttggaggtgggatctcaatttacacgatacagtattaaccaaatcttgatagcaaaaaaatgcaaaatatcgtataagtgaaggcaaagcattgtccaatgtaaggttctgtgccgcccttcccttttttgaaagctgctagatatcattgttaccctttttaatttctacgctattctcggacgtcataattttatagttactgacactaaaaaaagggtcgtacgtcttactggcagcgcgaaaaatgtttcgaaaatacaccttaacacattgaagtagtgatgatttcataaaaaaccacaagaatttgttcgctaatacattaattcggtactagactttattgactcgtatatttctaacgaataaatcacccactcttgctatcctaacagtatttaatattagctatttaaaagccttaagatggactatggctacttttttcccgcacaacgtattgaagaaacaaatggtgtggatttttggatagacagtaatgctgaatttacacagtctaaaagacctgactcttcaacatccactctttcgagggttttaacggacaccacgaatgtatccaataatagtggatcactcaaaagaaaaaccatcaagaacaaaatattcccacaaaggaaaatattgcaacgatagcgaaaattttgactttggtaaagccaacactgattgtaagcatgtgtttaaaagtatttctaagcaactgatttttcttccaaggtgtttccaacatcacagtatccgaggctggatgaaagacagatactccgaatttggttataaaataaaaagaaatcaaaattgtcccccctcagcatgtgtacaggcactatacaatactagtagatccaataccgaagagtcaaaccccaacagtctggattctctgataatgtataaatacatgcgatactctgaaaagaaaaaggaattgatgtgcagattttgccaggggaataattggattctagctgaaaactacctaaaacatttattctttgcgcacggcattttgtctgaatttaagcctcacactttataccatttcgagtctaagctgttaaaaatccagggaaaacttaatttcaaaattcaagtattaaaagagccagagtttagcaaaaaaattttgaactctcttactgtatccatcattccctctcctttggcctactacactcaaacgttgaacgggggatttaggagaatccatgtgaaatgcccccactgcgaaaattggatccgtttgggttggtgtgaatacgatgaaatcattagggattcctttcaggatttcgagtctctaagaaacctcaatgctgattataatgggatgtcgtatattcaaacacgcaatagagaagacattgaaggtatatacgagaattattttacacactacatccaatgcgacttagccacgttccgaacgaaatgtttatatgtccaagttataacaaaagcaattgattgtgtacgcaagatattaaaaataaatgatcatataacaaatcaaacaaaatttgccgctagtaacgaactaaacgattacgagacggctgataaatactaatattcaccatcctagcgaagaaacgctttaaatttataacggttaccatccaaaataatgaacataagcagatctggcaccgtagcagctcattggggaaaaaaaagctgtcatgtagggccctctgagcataataaaaaaagaagatgcttccgttcaataacagcgataggtagatgggggaaaaaaaggagaggaagatgaggcccttatgtacgtgcatatatatgtgcgagtgcacgaaagtgcaccacggcaatccgcgtaatcaagcttatgtaaatggcgtgtctgcgtaaactctgtccctgcgaaaatgtgtttatttatagactgttcgcattgttttttccagcccccatccggagacgcatgaaaaggtgtggcctcgatacatattgttaaacccatcaacctagcttgtagccaaacaaatcagtcaactctctcatagctctttcaattttaattaccagtagtccgtaagggaagctaccttccgcaatgaacaatagcaaaaggtcgctattgggtatctgtgcgacacaggtatgtaaatcttccatttcgtaagtatatatttttgtcttaaaggagtcgatttccacagggtaacagctattggagtgctgttcctcagtatcgttttcatcctctgaccacttatccttaatcaataagctcatcattttcaagttattgaccgagtttatttcgtttatggaatttttcggtacatcgttgtttgacgtcgcataggacagtatacccccattagtggcggttataatcatagacgattgcaaagacgatgtcttgaagtctaccgaatgcaaatcatacggtttcaaagtgttttccagaaaccctttaacgtttttagaatggagcatcaccatattgcttcaatattttggataccgtttgctgctgataactgccttttttttttttcttcttatcttcccttaattaattcattagagtctttttagcttatatgccaaatgaagcaattgtttttctttttcttcgtctctctctccatattcacctgttacccagagggcaccattcatatcattatcaacgtaaaatctgcgaattaccgtaaaccgcaaaaaaaaaaggatggcgggcagtatcatccttcacgacccgggtggctcgtgcgccctccggaaaaagaaatgaaatggagtgcaaaaacgggaaagacgcgccaccgtttctggcccacgcgctcattctcagtggccaggcactagagacaggactgaaaccgcgttaccacaacaaacaaaggcaacgtgcagtaaacaaccatccctcctgggatcgaaatcaaaagtacaaacctcagatcgaactgaaaaattttcggtagcgtgcttgagccggtataaatattcaatgtcaaacacctacgactttcgcaatcaacggacctctcttgcatttttgtatttaatatgtgaagatctttcctctgcattttctttccttctttatctttcttggcttttcaccctttctcttctttttagaacatcatctttgagtacttcggccacttttagaaaagaaattaaataaaagagttaatcgttcattcgcttctacacagtttaatcttttccatttttctttcaacaagtccctttgagctatcaagaatacgtttatttgacttttaaagatctagttttaattttactattattccgcaatgcaattcaagaacgctttgactgctactgctattctaagtgcctccgctctagctggtatgtacacattctccttttttttcatctttttttctttatttgcctctttcctcacaaatctcgagtagattcgtggtcctcttcattcttttcttttttctttgtcgattactgggctttttttcataggtctcgattgacgcggacggacaatgcgaaaaaaaaaaatttccaaaagaggaaacgggtttcgagatctcgtgaggatggttttggaatattcttcaatatttctgcctgtcataggattagggcgagtaatgaaacagaataatacatgtataaatcgatcgggaatactaacactacttttctttatctaagcagctaactcaactacttctattccatcttcatgtagtattggtacttctgccactgctactgctcaagctgatttggacaaaatctccggttgtagtaccattgttggtaacttgaccatcaccggtgacttgggttccgctgctttggctagtatccaagagattgatggttccttgactatcttcaactccagttctttatcttctttctccgctgactctatcaagaaaatcaccggtgatttgaacatgcaagaattgatcattttgaccagtgcttctttcggttctttgcaagaagtagactccattaacatggtgactttgcctgccatttctaccttctccaccgatttacaaaatgctaacaacattattgtttctgacaccactttggaaagtgtcgaaggtttctccactttgaagaaggttaatgtttttaacatcaacaacaacagatatctaaactctttccaatcttccttggaaagtgtctctgactctttacaattctcttccaacggtgacaacactactttggccttcgacaatttggtctgggctaacaacatcactttgagagatgttaactctatttctttcggtagtttgcaaactgttaacgcttccttaggtttcattaacaacactttgccaagtttgaacttgacccaattgagcaaggttggtcaatctttgtctatcgtctccaacgatgaattatccaaggccgctttcagtaacttgactactgttggtggtggtttcatcattgctaacaacacacaattgaaggtcattgacggttttaacaaggttcaaactgttggtggtgccattgaagttactggtaacttctcaaccttggacttatcttctttgaagtctgttagaggtggtgctaacttcgactcttcttccagtaacttctcctgtaacgctttgaagaagttgcaaagtaacggtgctattcaaggtgactcttttgtttgcaagaacggtgccacatctacctccgttaagctatcctctacttctactgaatcatccaagagctctgctacatcttccgcttcttctagtggtgatgcctccaatgctcaagctaacgtttcagcttccgctagctcttcttcctcttcttctaagaagtctaagggtgctgctccagaacttgttccagccacttcattcatgggtgtcgttgctgctgttggcgttgcttactataagattaaagcaacaatttgtgtttctattattactttaatttcttctctaatgatttctttaccattccttttttattatgagacggttggttcatcactgaattttatatgtagataaaattttagtgtcgttaatatctcttttatttcttattgttactatattattactgttttgaagttccagtttcatcaacttttgctaccttaattaaaagaaccactcagactttttaccatcctttagctttacctaatataatgaaatttgtctaagtaacataaaaaaaaggagtaaagaaaaaaaaaaaataagtaaatgaaataaaatataaaaaaattcttactacggtttaaaacaaagtgctcttccgctaacgtttcaagtttctaaagaatcgttagggccttttaacggatcgcttttttaaaacagtaaaacgttatttatagttatttataccaactatttctcgaaattcgtttttaaaataactgccatctttactgctcttctgctccttcctttgacatgaaaaagcaatcagaaagaaatagtctaataaattgttattatgtacacatactcttatacgtataaaaaacggtataaattaagtagatcattttgcgttgtctgttacctgccccccttggccaatctcttggctctcaacttttcagccatagtcattttctttggaccagaagatggagttggggttgctggggttgctggagtagctggagtagctggggaggacccaccagctgttctaccggctagtctctgttcgatggcttcttccatttctctttgtttttgagcgatcatatccaatttagctttatctggagaaacggtcgcctttggtagagtgcttggtgtacttggaggttccctgtttcctgcgcggaaagagtatggagttgatttcttggcagcagcttcttcgatttctctttgtttacgggtagcctcagcgagttcttgagcacgcttctgtctttcagcatttgcaatttcttccttacgccttgcaatggcttcctcgtaacgacgcttacgaacttcttcaattctggcctttttggcagcttccaattcagccttcttttggttgcggatggcagctaattcgctttccttagtgcccgaaacatgctccttgaacttcaaataatcatcatagaccatgaccaagttcttacgatcagccattctggcttcgtattcggccttggcggcgtcgacaatttttttcttcatagcttcataatttgctgtgtctgtttcttgtagcttgtcaacttctttttgcagcaatggcaattcgacctttctcaaagctctttccgtatgatctaacttcttcatagcatattccatacgactttccaattcactcttgttctttgatacctcagctataataacctgtttaatggtgtcaagatctaagcttttagcttcgttagggtcaatgtaaacatgtcccttagcattcacctcagtaatcatctttgtgatttctctttctttgatagcttcaaattcacgtttcttcttttcaattaagcgacggtgagcctcttcttccaatttagcttcaatagcagctttttcttccaaaatacgctgttgtctgacctcagcatcctgttcagcatgtagggcagcatgttccatatgtttttgcttttgctcttgagatctcttgacacgttcgtcaacaatcttggaaatcttttcaaggtcatccttgttcttcttaattaaagtttcacgggcaattctaaccttttccatgtatgaagcattgttgaaactgtcaacatcgtgtaggacattggataattcaagcaacttgttgtggatgtaagaattgcggataataacaggatcagattcttcttccttttcttcaccgtcttcagtttcttgtggcccaagagcttcgtcagtttcctccttttcttcttggacttctggctctgtgttttcttcttcagagacttctttagaagcagttgatgcgaaaatgtcaaatggatctttagcgaatgtaaccttagcagattcatgatcgatggtaattgaaacataatcttccacagcagcttgtaacagcgatttttcgatgtcccaagcagataagtctaacggagcaggtagggtagcgagcttgtataattcggactgggagacagtagtgaatttttgagaggcagcaacaaaaacccttctcataatgacgtctcttaaaggtgcgatgtattggctgaagtaggttttagaagacaatttgactaataaattttccagctgttgtttcactgtgtcgacatcaaagttaacttcaatgatatcgtacaattctttcaattcctcgtcaactttaccataaatggattcgtcttcaataatggattgcaacatttcctttctagttggcttggcgtccaagtttaataaacggtacatacgtaaatgaggatcgtagccaatagatggaatttcgtctagttgggtagaaatagcggataggaaaattgtagaagaatatgttttgaattcttcttccgtggctcttggattggtagaatataacttataaaacttcttccaggcagtagtgtgcaacaatggatcaccggaaacaaagaagacctttacgagattctcgtagtaattagccaaagtagatggtttaggagcacgtttggatattttcattaagtggaaaacatcctcaatggatctataagcctcgtgccacaattccaacttgacagaaacatcgacttgttggaaacgttgatctaaataacgttgcaaggtatcagcatcgctcaagtcaactaaattgtttcctgatttactttgttggtagttagcagcatctaaatgttgacgtaacatttcagctaatctcttgaattcgtttttacgctgatacttcaaacagaaatgcatagtttttttaacgacaccagaataagtaatttccaacaaagcgttgtttctcaataaatctaagactgcacgatatgattcccaagtaaatcttaaccatgaagtaatggcttcatcattgaaaccagccacagattgatctgactcgtaaacagaaatcagcaaattttctggggtaacaccaccttccaaatcatcatcgatttcttgcttttgaagttcgtcagctctagtttgttcagaagcgattttagattcgactaaatcaatgaatttacgtgcaacggcaccgacagaaaccaaaccttcggtagatccttgaattaattttttgtactggtgcaaaccgtcttttagcagcttacctttctttagttcaacaccaatttccaagaatttaaacacgactggctcaacagttgaaggtgtagcccaacggattcttctggcagttatgaaatcatgcaaagattgtaaagcagcttgtttttcgccaacagaaataagttcatcggctctcttaatggcattttcaggacggaatggtgggggggccatcttgatgtttcctgggcgtttgtatggtttattttggaactctctctatagttgtaagtatatctactttcgatttagttcaccaagaaaaatttttcacctggcaaagcttctcgggcaaagcgactgaaaaattatcatctttacccggtgggtgataattatgacaggcagattccaatgacagaataaaaggaaaggatgccttggttttgataattttataaaatttatcactaaaatatataccatagaggaaagaacttgttcactagatcctttctgattggaagggataaagaataaaaatacaaggacatgaaaaatttgaaataattatgcggattgggtcatcaactcaacaagctcgttcacgggatcttcatcgtgccttgcggtttcaatgttggtcaaggtctttttaataccgacattgaagttaggacagctccttgataattcattaataactttaactctaccagcatcgtcaagaaagtttgattctatcatgacgttgttcaattcatctaaattggtcatatttggaactgctatctcattgtcgaagcaactcaagatatccatttgttgaagtaccgaataagctgatgtagtagtcatgatcaataaacgacggtcttgtgggggtttacgcttcaatgcaacctttagcatttgtaaaatgttattagagaatcttggaccaattggtacccaatcaactagagtctctaacgaatcaataacaagaatgtttagtggagatttatacgcatctctgaaagtgttatcaatataggcaatttttgcgctttctgacatgcctgacaactcgttgggagaaattaacctgatgaatgggaatccagattttaaagcaatttcagcggctaaagctgttttaccggaccctgcagggccgtggattaatagagatactaacctggatttatcactctcgcgaacttggcggacgtaacgggctccgttcttcaatattgagttaactcgttcggaataaagcatcattccaccttccacacatgttttcaaatcttcttcactaatcccaaaagcgggagtaacatcgttgagtgcatttaaaaagtcttctcttgttactttaagttttgctatatctttagtgttaagttttgtggcacctttcccgatgttgacggttttgttgattgcaaaagaacttgcactcttcactaaaccctcaatctcagcaccagagaagttttttgttaacgcagctaactcagctaagttaacatcgtcgctcatcatattattttccctcattttcttcgtctgaatgtcgaaaatttggagtcttcctttttcatcgggtaaatgaatttcaacttggacttcaaatctacctggacgcaaaagagcactgtctattaaatctttacgattggtcataccaataaccaaaatattattcaattgatcaacaccatccattttagctaacaattgattaactacattgtcccctacaccggtaccatcacctcttgaacctctctgcttgaaaacagaatccagctcatcgaaaataataatatgtaaggaagattcctcacccttggccctatattctgcttctgcatccttaaataaattacgaatgttttcttctgaagaaccaacgtacttactcaaaatttctggaccattgacgattttgggctctttggcattcagcattgtaccaatctttcttgcaattaaggtcttaccagtacctggaggaccgtacaatagcaaacctttaacatgagaaatacccagtttttctataactgaaggaggaaagattcgacttgcaaacgctcttctgaaaattttagtaaactctttatccaaaccaccgacacccaaatcttcaaacttgaaatccggtctgatcacagcatttgatcttggtcttaatgaatttgatgatttcaaattaactaaaccatctcttcctttgaaaaaattaatttgtgtttgttttgtcaaaattccctttgtctctatcccagttgcaacagcggaggttggttcaatatcacccaaatcgattgcttggacatttctaatttttaagtcaaagaaatggccttggaactccatgataaggtactgggtgggagaaaatatttgagattcgtagcaacgaacaaattgtttggctaactcatcttgatcgaataccgtgcttaccgccttacctctagctctgaatgagatatctatatctattgaaccaagatacgattgcttaccggaatacttgaataaatcaaatgcttttgcttgcacgtcttgatttagggaccaaccaccccaggtacgctggttaccgttaaatccaatggttcccggtggaatgtcgttggagtgtctagttgtgaaaacaaataaattatcgataataatataaatgttattagggaaatcatttggtgagacagcagctacgtttgcgagtgcataggagttatttggacagtttgacacctttaaatggcgtgtacgggtatccatgtttgtcatatctggtggagtatgatttgcagcagcttttccaaaaccaggtatcttgaacatactcaatttataaaggctgaatatacggtactatttgctcttatctttgagagaaacaacggtagtacttaaaggctacgaataagccaatttcatgaatctcgaaatttggtacgcctaacgtatagtgtgataccgaattaacccatgggaaatacctttttttagtgacgctacgcttgtgtaaagagaaaaaaatactaggtgacattttagagagggtactgcagaagtataaagcgtactctgagtattaaagtgcattgaattggaatcctacatcaactacaagtaaatagtacaacctttataagcaaatgtatttaattaaagataaaatattcaactatttagcgcgctcattattgattaaggcgaggaaggctcaagctaaatgaactattgctgcccatattggtatcatcaaaagcatcatccatatccaaaggatctaaaggttgaggcgttcgcaaaaataaggaagaatctccatcattttctgcacccactttggcgtttacagttgttgttggatccgcttttacgtcgttttccaagtcttcttctggaagtataaacgcgcttgcgatcggtttctttttgtatgtggtacttatcttaccagtaggaggtaatcttgccttcgttgcggttttctttgagacaaactgatcctcttctagtaaagcgaaagaattgtcttctgtggaagtcattgaggttttatcatttgcagatgacttgctttgctttgctatataggccttggaacgttcataatctttttgtaataggggaagtagagtattccagaatgaaccagcatccagcataccttttgtaattttcttatacacaatgctgtctgattcttccggttggatctttttggcctgcactttggtttccccgtcaacagtttgaaactgagtagtcagtaactgtaatggaacagatgaactcaaaactccaaactccttttctaatccaagctctctaaaaccaaagaagtcttcaccagtcaattcgctggcaaagtcacctgtaaaaaagctttggctctcgtcttcaaagtttctctcggacaactcctgcaaagttggccttaataaggctctcaaaaagctttctagtttctgtttgatgtcctgaagtttcttagtttttttaccaaattcagattcaacataggaaaatagatcgtctggcctgttgataccgttttccaacagtgttgtttgcagcatttccacatttgttcctctatttaaggagttagtttcatgatgaagcttcaaagtctttatcagattagataggtaatccccggcgatttcagtaagcatgtttattgctgatggatgggcagtttcaaacccattggccatagcaaccttagatatgttcttatgcatgaatttccatatcagctccctgttgtttttgtaatcatgcgttggaagctgtgacaccggatcaatatcgagtgagtcatcaataatagtgtaattataaatgtggttgttaaggaaagcgttgggattgcttctggagttttgagccgataaagggctctgtaacattctgatcagggatattttatggcatatgtgcctaatttgctgaatcagtgtgatattttggttcattttaggtgttagtcctaaatccttgttagccagaaatctgctttgtttgttgataccattttgaagcatgcggtccacggaagcgtcttccatcttgtctaatgttttagtatttactccctcgtatactatgtcaggaatggcgttactaatatcatattcctgtaggaatctggtatcatctaactcaatatcattgggttgcttttcaaaagcttcatttccatttaaagagtgatcattatgaaactgcaattggtcatcgtcttcctgttttagtactgttccaaagccatttttcataatggaattttgctctattttttgacgatatgattctaaagctttctgctctttatattcaagaaaaagctggtcgaaccttttcattctttgtgggtttttcaaaaacgcctctgaatcactatttaattttccatttttaaaatattcagttctttttaagcaaatttccgcacgaactttggcagttacagttttccacacggatatttccaaatcgtctctatcgtcatccttttcaagtaaataagattgggagtcgaccatgtcttcgtcttcatcttcgtcatcatcatcctcttcctcttcattattttccccagcctccttattttctgcagttttatcttgtagtccgtcttccgtatcctttttggcagcatcagcatcttttgatgaatcctcagtcttactactttcctcaaccatatcttgctcttcatttttcccattttcttttatttcgttcttatttacattttcgtgtaccgttacagtagatgaagcagttttatctttctctttttccccctcagggatgacagaagttagtttgtcatcattggttggtgcttcatccttgacggttttagagctatctttttctgacaccttgccattctctttggccaacatatgagctcccatattcaatccttttcttccagaaccagcaacttcctcttcctcatctaattcgtagtctttgtctttttccatatcttcaatttccttttctaaatcagccctgtttcggattgtgatatttggaatcatgcgaatcaactgaagagatttcttctgcatagcaatagcatgccctctcaaaaaatgtgaaggatctgaattataggtcaaacaatttttccatattagcataatatcgtctacaaattcttgtttggagtcatattgaaagcttttcagtttttttaaaacagtattcaggtccatggactttttgatgatttgatgataattgggggcttctcttttgctcactttattcagaaatggtgtagaatgctcagtgtagtttctaagttccaaaacaaccttttcacaggcttcgtataattcctcttgcccaattctttcatccgatgtccattttgaccgattttttctgacatccataatcagatgttttaattcgtaatctgatattcctaattgggattttttttgctggatagatgatagaaggtgctttaatgataaattttcgatgcctagattgactgttaaatctaaattactttgtttggggcgcttgttcccagtatcgctgaatgttgaaccttcaggagtgggcaatttttgattagtatctggctcatcatttgtattttcgcgatcttgttcatcggtagctgcttctaaatcacttcgacttcgtttcttctttcctttctctatcattttatcgctttcttcaagttttaatcgctttatcatagtttctttatcgtattcaaaactgtggtaaattttgttccaatttcccataatttcttctacattatttgtttttaactttgacagtgtttcttttgatattgagatatttagcaccaagcgtcgttcatcgtcaatttcgatattagaagaggaaatagaatcgagattttttggaggatcatcgacattttttacgtctgtactgtcttcatcatagttctcgtcttcatcgtcgtaatcttcatcctcggcgaacttcgaaataccttctttgttttgtggcttctcatttttaccaatttcctcttcctccttctcttcaacatctaatagggtgtattctgtatcattttcatcaccaaactcattacgatcacagtatatataatctatggcgcactgccacaagacgtatctgattttcaaggataagtttccaataaaccttgttccgcttatttgctgcttcaagtcctctagatctaatttgaataagtcttcttcaacattatcactttcgtcattattcacaaaattatcttcatttgctattgcgttatcgcctttatcttcaatttcattttcaacatgattttcattgctgatactggtgttggtattagtattgttattgtccttaattgtttgtgatgatacatcatctgatcgtgtgtcaacggcaggagagaccgctccgtgatgttcttcttcttgggttaatggaaatgatttttcgacatttaatgctatgtttccctttaagaaatagtcccatgctttcagtttgtcttcttcacttgaaatcgacagcaggtattcaagaacgaccaattgctgagaggttaaatagagatcaaaaaagttcttgttaaaaagtttttcagtcaatttaagtaaagctttggcatttgttctttgataattctttattggtattctttcagtcattattcagacttaatttctttgtagtgttacagtttaaagagtaaccaacaattttcactgatccgaagttcaatctgaaaaaaggaaagatcttattgtttgacttgctaaataaataaaagatgtattttgccaacttctccaatgatcttttttcctttgtacatctaacataattgaagacttacgagtgtacattcacttttcattacttggatctgaaatattagaaagttacccgtaccatcaagaatataatcgcagccctaataattattcactggagttagtcccaacaagcattcctgtagagatttatttcagttaaagctggccagcatttgaccaattttcctatatgtacaataaaagagcataaggtttcagtggggtattttacctttaaaaaaatttcgtctttattctaaaaagccaattgaaatatgctaactttcatttaatatatccttgcattggtatttatacagatatattacagatataagtctttaatacaagccgacaccaaaaacaaatgaattgtcatacaagaataatactggaagcacatccatctttagaggaaacatgttttcgttatttcataaaaccttcaacaaatagtagctcgcgtggcgtaatggcaacgcgtctgacttctaatcagaagattatgggttcgacccccatcgtgagtgctttgtttcttccgtgatagtttaatggtcagaatgggcgcttgtcgcgtgccagatcggggttcaattccccgtcgcggagatttttttggctactcctgcagttattcttctgcctccttagtacagtgtaatgctcctcagaatttttgccaaacagagaaccagtcattgatcgttgattacatatactagctatgcgttgaacttcaaaaatttaaataggcttcaccccagaaatgatgttaatgacaatagtaattaacctacagatagactagaaatgaaaaaggtacggttaacgttgacgctccctcgacaagttaggtcaaatatgaaccacaactgaaatatatgcgggatatacccgcgcttgcgtgcatgtaactaagcaaaaattctccatactgttcgaggaaaaaaatgttcatgaatctcccctgaataaattaaattaaggtttacgattcgagttgtttggaaaaaaaaaaaaaggttcccctgtactgttgccaacaatagtcttatatcttatatcagtaaatctatgttattagagatagaatatacatatattttattgtattctttcttaaatacattgtatctaatattcttttcatcgtccaatcccatataaatcttgcttctctttttcagctgagtaaggacttctgtttatacagcgtatttctttgtccattctctggctgtagcttcgtacttgggtctgtcagtcttgtagatatgagcgatttctggtactaaaggatcgtcaggattagcgtctgttaacaaagaacagatggataataggaccttcgatagagttagagctggagaccattgatcctttaggatgtccagacagatgttaccattggcattgatatttggatgatatatcttggttgtgaaggagatctttggtggcttgaatgggtagtcggttgggaaatggatagacaagaagaaaacaccgccggcatatggggaatcggcaggtcccatgatggatgcttgccagtgatatagatcatcgccgactggaccggctgaacatgaagtaggtggatctctagttcaatagcatgttgattttgttagtaaataagagcataagttttaaaaaaaaagcacgcatttgaaacgtggccataactttagacatacctttctagatcacttagttctttagcaatacgtttagaagaagacatgtttttttggatgcttgtttatgtatgtactctatagtcagtgaaatttatttacttgtggcgatagtgattttcctggcttctttactttattttttttcaggatagatttattctctggattatttattaagatgaaaaataagaataaagaaaaagaaagaaggatgaagaaaaaagaaaaatacaggccaaggcctttcaaggtgagctgttgccaggtttttccgcagcgggaaaaatctcgcagaccatgtgaccgccggtactccttttcctgttgctcggccatttgatcctcgcttcgagaaaaactataacaattgattagtgcggagaggaggataggcggtaagatcagttttgtttattgtataaatgagatactttggaataaggacattagccttatgttacatcatttcttatcacgtaagactacttattgtcaaactttttatgaagtcataaggtggacatatgaatagtgcagttacccttgttcaggaatgacaccttgtgcattccagtgagaaaggaatgttgactaaaacagtagctgtgcttttttttttcttttttgcctttttattcttaatgttcaagaaaactttctttccatggaatgtatgaggaccctttattttgaggaatgggttcgaatttatcatgcaaattggcaagaatttactaagtggactatatttaaagagttgaattttacggtgaaagtaaattaacgctacttctgttgttttggaaaagccaagttcaagtttcttttcttgattatttattctcgtaacgatttcgcttttcctctctatatattttcctactccattctgtaaagagcttccagaacaaaatataaataaataaaaaaaacttctcttcaggcaagagtacgttcttcgctggtttcctacagaatcaaaagagtactgcagcttattgtacacacttacaatattcaaaacatgtgtggcctactcggttcctggcaaggttaagccaagtggtgtagttaccagaaaaaagtgaacacatacaagatacgatgcgtaagtacataaggtatgacagcctgtaacaaatccacgttagatttatatcttctaggctgagaatctggcaggttttagcaaaacatatataacttgctctcattaagcgggctcactgcttaagcgattgttacctggaactacaggcaagtacaatagcctcctccagcttttgactctgaaaaaaaggtaacgaaagaaacttttcacacagataggaactattctaatattacagtaaagccagctatggaataacaggtggcatgtgcccactgtattcatgtatgagcggccttttttttccacgaaaacagatatgatgatgttttaggccaaaatggtgagatccttttacaggaagattttacgccaactctttccatttagtgacacaggtgagggtcttttatcggcgcaaggtgtttcagatgagccattttgcccgtagtccggtttaatcagcctcattggaattccccggcaccgctcgcattccgcgtacgactcaaagaatttcccattgaattcgggaatgtgcgtgtttcagattgcgtttgcttattattctgggaaactctccggaaacaagctgagctggactccacgaatggtccctcacaaggctcttggctcatgcacagttaaaaagcacctgtagctaccatcagcaatccatggtgctggagtttctctcgatggtacggcccatagctggagaaaatagcttattaccaaaaaagtaattcccccgcagaggtatatattaagtttgaaacaaaaggcttgcttaattttttacatatgacaacccttttcttacttttataaatgtttatgaaacaggagattcttcgactggtgccagattcctcccatatcgacaagaagaataatccacctatttcaacaattctgatacctgtttaaccatgagtcttaaagaagacgactttggcaaggataattctagaaatatagaatcatatactggtagaatttttgacgtatatatacaaaaagattcgtattcacagtcggccttggatgatatgtttccagaagccgtagtttcaaccgccgcttgtgtgaaaaatgaagcggaggataacatcaatctcatagacacgcatcctcaattcgaactggtaaatactggactgggtgctaaatcggacgatttgaaatctccatcagcaaaggctacgttcactgacaagcagaggaagaatgaagtaccaaatatatctgtgagcaactactttcccggacaaagtagcgaaacgtcgtcaacaacggaatcttggactatcggttgtgataagtggtcagaaaaggtagaagaggcattccttgaggcacttagactgataatgaaaaatgggaccacaaaaataaaaataagaaatgccaattttggaagaaacgagctgatttcattatatatcaagcacaaaaccaacgagttcagaaccaaaaagcaaatttcttcccatattcaagtctggaagaagaccatacaaaacaaaatcaaggactcgctgaccctatcatcaaaggagaaggagcttctacaccttatcgaacatggcgctgaacaaactactgaaaactcaaacctgttttatgacatatttgaagaaattatcgactctctaccttcagtcagtgattctggaagtttaacccctaaaaacctctatgtaagtaataatagcagtggattgtcagtacattcaaaactgcttacgccaatcactgcttccaacgagaaaaaaattgaaaatttcataaaaactaatgctgcatctcaagccaaaacccccctcatttacgctaagcacatttatgaaaacatagacggctacaagtgcgttccgtcaaagaggcctcttgaacaactttcccccacggaactccaccagggagatcgccccaataaggctagcttttccaacaagaaggcaatcctggagagtgcaaaaaaaatcgaaatagagcagagaaagataatcaacaaataccaaagaatttcccgcatacaagaacatgaaagtaatcctgagttcagttccaattccaattccggttcagagtacgaatcggaggaagaagtagtcccaagatcagccacagtcacacaactccaaagcagaccagtgccatactacaagaataatggaatgccctactcactctccaaagtacgaggaaggcccatgtatccaagacctgctgaagatgcttacaatgccaattatattcaaggtctgccccagtaccaaacatcttatttttcgcagctgttattatcatcaccccagcattacgaacattctccacatcaaaggaactttacgccatccaaccaatcgcatgggaacttttattaaatgtctacatacatacatacatctcgtacataaatacgcatacgtatcttcgtagtaagaaccgtcacagatatgattgagcacggtacaattatgtattagtcaaacattaccagttctcgaacaaaaccaaagctactcctgcaacactcttctatcgcacatgtatggttcttattgtttcccgagttcttttttactgacgcgccagaacgagtaagaaagttctctagcgccatgctgaaatttttttcacttcaacggacagcgattttttttctttttcctccgaaataatgttgcagcggttctcgatgcctcaagaattgcagaagtaaaccagccaatacacatcaaaaaacaactttcattactgtgattctctcagtctgttcatttgtcagatatttaaggctaaaaggaaatgttgtcgagactatctttattgagtaactcgagggcgttccaacaggccagatggcgcatttaccgcttaaaagtttcgccaactgtgcatgcttctcaataccatattctttctggtaggaaacttgctcaatctattcgagaaaaagccaatgatgagatacaagccattaagcttaagcatcctaatttcaagcctaccttgaaaatcattcaagtcggggccagaccagactcatctacgtacgtgaggatgaaattgaaagcttcaaaggacagcaatgtagactgtatcatagagaagttaccagcagaaatcactgaagttgagcttttgaagaaaattagtgacatcaatgatgatgactctatccatgggttgctaattcaactacctctaccgcgtcacttggatgaaaccacgattacaaacgctgtggactttaaaaaggacgttgatgggttccacagatataatgctggtgaattggctaaaaaaggagggaaaccatacttcataccatgtactccttatggttgcatgaaattacttgaagaagctcatgttaagttagatggtaagaacgccgtcgtgttaggcagatcaagtatcgtcggaaatccaattgcttcgttgttgaaaaatgcgaatgccactgttactgtctgtcatagtcatacaaggaacattgcagaagtggtctcccaagctgatatagttatcgcagcttgcggtattcctcaatacgttaaatcagactggattaaagaaggcgccgtggttattgatgtaggtatcaactacgtacctgatatcagtaagaaaagtgggcaaaaattagttggtgatgttgattttgattctgtaaaggaaaagacatcttatattacccctgttcctggtggagtgggtccaatgactgtcgctatgcttgtttccaatgtactattagctgctaaaaggcaattcgtggaatctgaaaagcttccagttatcaaacctcttccattacacttagaaagtccagtgccttcagatattgatatatcaagagctcagagtcctaagcatatcaagcaagttgccgaggagttgggaatccactctcacgaattagaattatacggccactataaggcaaaaatttctccaaatatttttaaaagattagaatctagagaaaacggtaagtacgtccttgttgcaggtattactccgactccattgggtgaaggtaaatccactacgactatggggttggtgcaggctttatccgctcatttagggaaaccatccatcgcgaacgttagacaaccatctcttggcccaaccctgggtgtcaaaggtggtgctgctggtggtggttatgcccaagttattcctatggacgagttcaatttacatttgaccggggatattcatgctatcagcgctgcgaacaatcttcttgcagcagctatcgacactagaatgttccatgaagccactcagaagaatgatagtacattttacaagagactagttccaagaaaaaaaggcatcagaaagtttaccccatccatgcagagaaggcttaaaagattggatattgaaaaagaagaccctgatgctttaacacctgaagaagtcaaaagatttgctagattgaacataaatcccgatactatcactatcagaagagttgtcgacatcaatgacaggatgttaagacaaattaccattggcgaagccgctacggagaagggttttacaaggaccactggattcgatatcactgttgcctctgaattaatggccattttagctctatctaaaagcttacacgagatgaaggaacgtattggacgcatggttattggtgctgattatgataacaaaccagtaacagtagaagatattggctgtaccggtgctctgactgcattattacgtgacgctataaagcctaacttaatgcaaactttggaagggacccccgtaatggttcacgctggtcctttcgccaacatctccatcggcgcatcatcagtaattgcagacttaatggcattgaagcttgttggttcagaaaagaacccgttaaatgacaagaacatccatgaacctggttatgtagttactgaagcaggattcgattttgccatgggtggtgaaagattctttgatatcaaatgtcgttcctctggattggtgccagatgcagttgtcttagtcgcaaccgtaagagctttgaaatctcatggaggtgctccaaatgttaagcccggacaatcattaccaaaagaatacacagaggaaaacatcgattttgttgccaagggtgttagtaatttggttaagcagattgaaaacatcaaaacgtttggaataccagtcgttgtagcaatcaacagatttgaaacagactcacaggcagagattgaggtaatcaagaaagcagccttgaatgctggcgcatctcatgccgttacttctaatcactggatggaaggtggtaaaggtgcagtagaattagcacatgctgtggtagatgcaacgaaagaaccaaagaactttaactttttgtacgacgtcaatagctccatcgaggacaagcttaccagcatcgtccaaaaaatgtatggtggggcaaaaatcgaagtatcaccagaagcccaaaaaaagatagacacctacaaaaaacaaggcttcggtaatcttcccatctgtattgctaagacacaatattcattatcccatgatccatcattaaagggtgttcctagaggttttacgttccccatcagggatgtgagagcttcaataggtgcaggttatttatacgctttggctgcagaaattcaaaccataccgggtctatcgacatatgctggttacatggcagtagaagtcgacgacgacggtgaaattgaaggtctattttaaatagtttggcagactcctaatggcatcaattcgacctcgatgtccgtctgcacgagtaccctttatataaacaattgagatgagaatattagaaaaatgggttttagttatgtaggtatatgtgcatacatacgtattatcgaagtttttgctacctgtttattaactgagtatgtatattaagataaattaattaaagaaaatttaagcgtcttccttcaataaagcatctctcttttcagcaactctttgagctcttctgtcacgagcagctctgttcttcaatcttctagcttcagcttcttcgttcaaagccttttcacgttgagcatcagccttagcttggatgatgtgttcaaccaaggctctcttgtgtttgaaagcgttacccttagattccttgtacaaaacatggtacaagtgcttgtcaatcttaccagcatcacggtacttagccaataatcttctcaagacacgtaatcttctgatccagacaacttgggatggtaaacgggcttctctggtaccctttctcttaccgtaaccactgtgacgaccttctctcttagattgagcatgggctctggttctggatttagagtggacggtaacggccttctttacgatggtaccgttcttaaccaattttctaatggcgtttctggagttggcttgagcaatttcagaggtttcatttggatctaaccaaacctttctcttaccgacaccgacgacagaagcggcaagtctcttttgagtacgtaaattagccctgttaaagtcatgttagttattatcgttctgtaagaaggaaaaagtctattcgcgtcgaaagatagaaattgcggtggtagacactttaaaactcgctatagaaaaatgacatggttattatgtatgctggatactgcagcagctcgagtaacttttatcacgtaactggttctcgtattgaatactcatattaatggtctcacttatcgctataaatatcttaatggtaaactgcacagaaaaaaaattcttccacaagtttcctcttttgccttttagtgctaaaactccgattatagaaacatctggcttcactagcatattcatgatgcaaatggaacacagtatcgttcttggcatatattacccatatcacttttcaataacgctggtgtttcaggtgataactcatcaaactcgcattcctcaagagggagttattataacaattctatcttattcctgataaactttcatagattcattattcactgcatcacatacatttttgctttggagttcttaatcaactttctatgtgaagcgtaaaatcaatagttaccttgtattctctgttgatcactgtccaaacctatatttttgtttccccctcagagaagttaggtcgatgcctatcgtagtttgcaaggaagacggcttccaactgagaccgccctagtctggcaggattcgtgaaaggagtccatgccagctgctacccagggattgccacggccccggccagcgtatagtacactgtcaggagcaattcgaagaggcaaccaaaattatgctaagcatcgcactctctctcagtctggtgctaagcggaagacatgcttccaatggcctcctcaccgagaacggatattaaacgaaacgaagaaaaaaaatcttcacggaaaatgcgtaatgtctggatgacaaaatgcatgggtgtaaaaaaggaaatgagacgaacttgtaataaaccttagtgggttgacgaattttgaaataaagtttttcctttttttttttttttttctttttcattgtttggttgccttcaaattacatataagatttctcgagaagggttttccattgtccttttcattaggcgttgaagtgaatctaaagtgcgcttgaatgatttcagatagaaagactaaagaagtggtgtgagtataattaactcaattgaagacggtttacctgaagtgatatactgtgccttgagaaacaatgagtagcgacgctaagcaacaagaaacaaactttgccattaatttcttaatgggtggtgtgagtgcggccatcgctaaaactgctgcctcaccaatcgaaagagtcaagatcttgatccaaaatcaagatgaaatgatcaagcaaggaactttagataaaaagtattccggtatcgtggattgtttcaagagaactgcaaagcaagagggactaatatccttttggcgaggaaatactgccaatgttattcgttattttcccactcaagctttgaacttcgccttcaaagataagattaagttgatgtttggtttcaagaaagaggaaggctatggtaaatggtttgcaggtaatctggcttctggtggtgcagctggtgctctttcgttattatttgtttattctttagattttgccagaaccagacttgctgctgatgcaaaatcgtcgaaaaagggtggcgctcgccaattcaatgggttgactgatgtttataaaaagaccttgaaatcggatggtatcgcaggattatacagaggattcatgccatcagtagtgggtatcgtggtttatagaggactatatttcggtatgtttgattctctcaagccactggtgctaactggttcattagatggttcattcttggcttcatttttattgggatgggtggtcactacaggtgcctcaacatgttcttatccattagacacagtgagaagaagaatgatgatgacttcaggtcaagcagtaaagtacaacggtgctatagattgtctcaaaaaaatcgtagcttctgaaggtgtagggtcattgttcaaaggctgcggggcaaatatcttgagaagtgttgctggagctggtgttatttccatgtatgaccagttgcaaatgatattgttcggtaaaaaattcaaatgatcagttggatgaagaaaaaagtcattttctcgacttctcttcacctttcgatcgatttgattttggccgccaacttgtttatagaaaaaaaatagtaggaaggttatgtatcgctttcttttattttttattatagagtataactgaataaatttgtaaatcagccactgttgttcgattgctttttggggaagtgaacttgagacctttaactttcggctttcagatggttggatagcaattttcacacaatttggacattgtctccaagttttccacaatgatgaaggttctttgttaagtgcattcccccccttttaagtaccttggctatcaattttatacccatttttcgtatttaccatttaattaacgatccaattattagcgttaattacggaagcgccaatgaatttttagaaatcagaaccatagttttgagctcaacggaactatccaggataatttctcaaagctttatcaagatgagcataattttcctttcggggtgtagaccttataagagcttccgcgtttttgttctacattccattgagaaatttgttgccaaagtttgccaatgatcaatggtaaacataacggttctaagactcaaccttcactatttggagagtgatgcttcaagataagcatcctgatccattttataatatttgttagggttttcgagaacttagataagaatcaattattgtcagtattattacattttggtttttaattttaacattttatttttatttttttgacaattctcaaataaatttcatagcaaaaagggagaaagatttcagaagaatacaaacttaggaccttcttatgactatttccaacattctcatcgtcctctcaacgggataaaagttcagttcctgttaaaaaagaataattcttactgagaatgaagtattcaaagaaatttaatatttttgaaatattttttgggattgcgcaaacatatgccctctcaaaagcaagacaaaaatttagcaaactttataacgattacaccattattttctcataattttcgctagacatttctacagtacttgtggacgttggaaatgaaagacatagtatgaaaaagatgatcaatttttcgcaattggttgagtaaatttcaggtcttttttggggatatttttcaactgagaaattcaaaactgacaagaattaaaaatgagaaaagattgcgagcttttctattcatgtgatacatcgccttttaattatatatagtcatgtttaagggattttagagggtaaaacaagttattgaaagggtccgtagtcggctgcgcaggaaatgccctttcatagagcggacgtaccacaacgcgcatgtagttgagcgccgttcctgctctgatcatactatactagacagggaaaaatccatttttaaaacgtgtgactgttttccctgtcggtcccgaagtaagatgaggttgcctaatgaatagcagcaaacgatactttcagtattcgtcctttaaagaattttgcacttttgaccaagacctctgatttgcgagacctcccagttcggatgctttaagacacctccaaatctctagaaaactcaactacaatgcgtccaggtatagagacgaaattaattaaatgaaaaacttatacgtatacgaactatctaccagcctgtaattcacttatttagaatatttatttaaattttttttaaaaacatcaaaagcagacggacaaacgttttaaaccaatgacagggtcatggtaataataatagctttatctttttttatttctttcactttcggttggtgaaatcaagtacttaaaagacctaacaaactctacaatttgcgcctttctttcccctaatagaacatgttagatttataagcgaaaacggaaaagaaaactacagcccagcaataagagtgcaaatcaaagtgtgcatgaagtgactcgtatcgaacaaatatttagccactcgttcaagcctggccggccaaatccaaaagataatctttggcctcaccaatgatattagcgatgacttcgccgtcctttagcacataaccatgtgatttatcctcgcttaaaactgtttgaatttcatagttctttttctcttgcttcttcaaaaactcctggtacccactgactgtcgtcagttcaacaggtgcgctttgcaagaaagaaccggtagaatgagtaaaatttgtgctttgtttgtatagagcagatgacatgttatagtataatgtaatttattgtagttggtaacttgagcccctatcgaatgaagagtgcgccgctttcccttatacaaactggagccgcaagtcctttgtcccttttataataatgagatgatccggtgataactacttattgccagaaaaagcccagatcagataattaatgggggcaaaccaaaacaagaaaaaaaaccgcgaaatgaagtgcgggtcaaaaagaggaaaaaggaatatggataacatgtatgcgcgcactgacgtaactgcacgtacttcagaagcaacatatattcaacaaaactaagcaagaagatattattagctgtaactatatcacatttagacttacccctatcgttcatacttcccactgcaaccctagttgtagttctgctaatagtcggccaatcttgaacatgtactgtaaggcccaaaagggctccagggatgcccttctacaaagcatttcacatgctaataaaagccccgttacataataacatctcccgcccacaaaagcgtttgatcctgtttttctatttgcttccataaaaaatcggatcacatttccttttcttccgccttagatctgcaccgagatcttttgcgctctattttacccctagaaactggacccggcctagaatctttcactgccaccagagagttttagcctcgctctcttttaatttgctgaaaaagggtttcctgatagaagccgcggttaatagaaaaacggcaaaaaagttatggtcggtatgttctacccccctggatataatcgtgtgactaacatacgtaatgaatcctagctgtgactcctctcgaacgaagaagaaagaggcaatgcatgcgtagaaactaaatcttgagatttctgtttgatgaaaacactgcacaaggtaaaatgaattattcttttaaaattagagatacataaaacatacacttgatagaaagaagaatacatattaatttaatgtcaccatattataaaaataaaatttgttatcgtcctagcttttttttaaagcttctttttcagcttatgcaatagcccctttttatgttttggtttttcctttgccgccgatgaagaggaagaggattcggttgtcttagaattgttcgtgacattcttcactccagcatcacgatggcggtggtggtgatgatgatggtggggctgagtagcatctgtagtagtagtagtagtagtattgttattagatggtctcgcagaatccttagtttccttcgtggaaatagatcttgatgggccatttttcgtgcttacttcagtcttttttgtttgttcagtagccactgaaaccttcgattggttatcgttaacagctgcgttgacaacaggcttaatatttgcatctttaatgagtggagtcttagtggcagcatcgtctttggcctgggtattttcgttattttcgccaccagtaacagcaattttgggtatttgatcaatttttctacttagtgcatcaacggcgtcaccatctggcaaaagcttactttccgtgcctaaggtgttgttattggtggcgttggaagattctgcactggatttcgcatccctaatggatttaccgtcctcatcaaaccttaagtagtaatttttagatgttggaattgtttctggtaaagtggcgcccgcaacaccatatgagccaacggtaggcaccttcaccaaagaatttcttttttcagtactttctgtggccaatggctttttaccagcagatccggctgtatcgttatcaacagctttgactacaccggttttgctgctagaagaagaagaagataatgaaggcgaggaggctgaggataaagaagacggatcattgttggcatgagtggcagcatgtgcctcatatccattggcagaagaggcaggctgtttctcaccgagttcttggtgcaacttctcattcgcagacccttttctttgaactagttctttttcgttattcgaattaaattcaggggagggaattttttcaaagacttcttgttttggtgggttttgcacgttaactacatgctttggcacaatgccatttgcaacgtcatcatgggaagatttcaaaatactagagaaaaggaagaaaatagcaacactaacatgctcaataaaaacagcatatagtacaatatttatccacgagtggtttattggatttgctaggtaccaagctttattcgtatggatggaagtatgagcgccgacacctggtatattacagctctggtacatataggtcaaagtagcagtgataacacaacctaagatggagaacataactaagacagagttccatagaccaaccgtcagtttttgggtattagacacagaggatggcttatcgtagattggaaatggaaaatactcaggtttactataaagcacagctttcctcaaatcgacttggtaaacaatcaaattgactatcaaacagataaatggagctagtggccaaattgtagaaaacataacaagatacccgaattgtagaagaagctttttgaagttggcgtccaaatcaaatgttgctccccaggggtctgtttggtacgacttaacctttgaccaaattttcatatctgatgagctgagttgagctttaccgatttcactctcagctttgacaaagttaggatttggtccattaattttctgctgagcaatgctaacaaggcttggaacaaagttttccatgctaaattgaatcagttggttgataacaataaagtagaaaaattgatcttcatagcgctttgtatcaataataaaatctgaatcatgggtaggtaaacgggccaatattgaaaaggcattgaaaaccttagttcttatttctgcggtcaacaaatgccccattggcagataaagaaatagtgtaattaataggggaacgtaactggatagaaaaataataacaaagttcttagcttctttagatttctttgcattcacaacactgctatgattttcccactttgtcattggttctacgaaatatttgttgtaaatcacagttaaaaccggagtaaacgtgcaaataagtatagtaggcaaaaaagacaagatggaaatcattgggccgttataaatttgcttgatgaaaatttccaacgcaaaacaatatagctggaatgatagtaatattgcgccaaacaacaaagccacaggaataaaacaacatttcttcaacatgataaccgaactagcttttttttgggctttctgtttatcttgaagaaactcaatggtagaaaatgatgagtatttactcagtctatcagaccaaaatggttcatatttataaagccaaaaggctgtaaatgacaatgtccataggatggcgaacagcgagtatgtggaattgaattcatacgtaaaattagataaaaatctaattgataatccaaaaaaggagaagggaatcaaccattttatatagttctgtaagaatgcaaaatataaggattgtttgggattattggtcaaattcgataggttgtacaactcatactgttttggagcctccagtatttttgatttgctgatagaaatcagtttatgcaaatcatcggacaattcagtatcatgatatggtatgatggattcaatgaagtccagattctgcaaaaatgaaaaaagcggtttcgcattatcctgatggattctaataaacgcatagcttgtttgcagatcatggccaggttcgataatagaatgtatattcaaacgtttgaattcgacattcaaactcttctcgtttgcactcgaagttttattgaatacaataacacaattcggatctagagatgtaattgtctgcgacatagtatgctcaaccgcttgtgcttgttttaatctttttcaaatgtatttgacaaattagccataaatcgaccgaaacagtattcaccttcaaaaatgttaatgatggtgagaacggttattggagcgactgttcaaatatcttttccagccccctatttccagcttcccttatagaaataattgcaacggggaaaaaagggatatttcttaatgaagtcaataatagctgcaaaaagaaaactatttttcagttgaaaaatatggaaagtgcttatttatcagaaagcttttacagtctttcacactgatgtagtggtggaatctttttgttttgaaaacaacagagaaaaaaaaaagataaaaaaaagtgcccttgtttgttttcgtccctagaaggaaaaaaaaagagaagtttctcgcagagtgaaaaaaaatgtcaagaaaagatcctacaagaacaaattatgcgcaataatatgcttcgtgctgttttaggatcttggagtcagaaataaaatagttttgtaaatttatgtaagatgctgtagtcaaatttatgtatcgagtctatgcatatgtacaccgtgttgaggaatcttttctagaagcactgcggtgtcgcctcttgaatattttaacgcgattttttattccttggaacataaaatagacttttcatttgtatgatggttcatggaaattatagattagtacagcacaaacatgtcattgtgggtagataaatacagacctaagtccttgaatgctctttcacataatgaagagttgacaaattttctaaaatcgttatctgatcagcctcgtgatttacctcatcttttactgtatggaccaaatggtacaggtaagaaaacgcgttgtatggcattattggagtccatatttggacctggagtctatagattgaaaattgatgtcagacaatttgtcactgcttcgaacagaaaactagaactgaatgtggtcagctcgccataccatttagagatcacgccaagtgatatgggtaacaatgatagaattgtcatccaagaactattgaaagaagtggctcaaatggaacaagtggactttcaagattctaaggatggacttgcccatagatataagtgtgttattatcaacgaggcgaactcgttaacaaaagatgctcaagctgctttaagacgtaccatggaaaaatactccaaaaacattaggttgataatggtctgcgattcgatgtcgcctataattgctcctatcaaatcccgttgtctgttgattcgttgtcctgcaccaagcgatagcgaaatttcaactatcttgtctgatgtggtgacaaatgaaagaatacaactagaaacaaaggatattttaaaaagaattgctcaggcatcgaatggaaacttgcgagtctccctattaatgcttgaatctatggcactgaacaacgaattagcattgaaaagcagtagccctataataaaaccagattggattatagtgatccataaattaacgaggaaaatcgttaaagagagatctgtcaattctttaatcgaatgcagagctgtcctatacgatttactagctcattgtatacctgccaatatcatcttaaaggaactaacgttttctttgttggatgtggaaaccctgaataccacgaataaatcgtccataattgaatactcaagtgtttttgacgaaagattatcacttggaaacaaagcaatattccatttggaagggttcatagcaaaagttatgtgctgtctagattaatgtaagatatgtcataaatactgtataagtcacacaaaaagctgatatttaacgcatcttagtctttattttctttgttatttattttcatttaaaacaaactttactgttttttttttgtttattatttttagtatacaactatatagataatttacatttattcttcgtcattaaatttaggagccaagaaaaactgtaggaacccactcttcaaatcaaattggaataaagcaggagcttcgctggagagcctgataccaactctatcagaaagggaggagcccttaatgatgtccaataaatatttagctccgaacgtcaagtcgacaggttgatccatttcaagtttgatgcttgtttcaggatgttccatatccacgaatggttttattatgactgaacctgatccgatatcaccgtcagctacaaactttattgtttctttggtgatcatgatattaatagaatcactcaattgggacaagtcacgaacaattttagagaattcggaagatggcaatgacagggtggagtcgtactgtaattcttcaatctttaagaaatcagcatcgatatccatcaatttcagagagtattcggctatacggtctttcttggtatcctcaaataataagatgatggaatccggtgtgttgtcagcaattagtgttaatgtatcggtgttgttaccacaacgtaggattttacttagtgaggttagatccatacctaacgtaacaggatggtcacatctatattcttggaaggcttcgacacctatttccaaggagaccaatagaactcttgagtcatcgacagcttgtgcaatgataccatcttctttacattggaaattgaccaactggacacaatctttgaaaccatcaattattctcttgaaaagggatgcttcttcaaattttgcttctaacattttttctctcttttgactgcgtacttagtgcttgctgcttgttgctgtgagtgaaaaaggacggcgaaagtgaaaggtgcaagtggaaagaaaggaaggctaaagcaaaagtgtttcttatatataattttatgtaccagaggaagcaaagtacgaaaactatcagttgaaatccaaaaaaaaaaagttacgcgtttcgcgttttggtgcgtcggatggagaagaaaaatgctaaataattagatattgaagaatcagcataagttgtgcgaaaaaggaagagaatacataaaagaaaagaaggatatataagtaaaataatgataatagtaataataataacacataatgcaacctactcaacttctttctgaagtttcaaaagtacgttgtatgggaggtagagaacattgagttgttagatcaagcacgtgtagcattgtacaattccttttcagattcgtatctcttcttgtctgcttgagccttagattcatagggttgcttttcttcagcagttaaggccttccacctctcacccaatattctgcctacttggccaaaagttacgtcaggattctcggaacggacaatgtctctgttttcattagcaaagaacatataagctgacaaccgcctcttaggggcgttaggatccttctttctcctggtggtcctcttctttggttcctttggttgctttgcttctttagttgcggccatagcgctagttttatatatgttaatgttctaagttaattagttagtactcttgtcgtgcgctatgataaacaaaggaagggggtgcacagaacagcagtcctttagaggatactacagtagaaagctagagtcctgacttacaacttgagcatgccgttatgggcggctatttcatttcacctgaaccgtattaaaatatcatcttccttgctgctacaaccttcattgtagccggtttataagattaccatcattgtctacccctctttaacttctcccgaaaagcagagttgcccttagctgtatcctgttctagctgtgctaaactgtacgttcttattaagcccatcctcgtccgctgggctcacccagcgccttacatactttgcgaaaaagtcgtttttctgcttggtgttaggagctgtctcccatagtgtaaactcccagtattgcctcaacctcacttgctgtactttatagttgccgcgccacctaaaaaaaaaaacaaaaaagacaccacctaaaaaaacgggtgaggggaatgcacgtgacccaggtgcgggtaccatataaatgtacttctaaaattgtctacacagcttataatgctatatatgcaggttactattatatacaaacagcacagacagtcctcatatttacagctattttttggaatcatcagctatttctttggccacaaatcgcgaataatgtcgtagctgattctctggcccgaaacctcgtgtttgtacaaatcctccaatgaggcgattgctgtaatgcatctttgccacacatctgtctatgcagcattgctcacctttcgttagatcaggctcaccaaagccctcatgcggaatacatttctcaagacacgtactgagaatattgttgaaagtcgagcacatcgcatcgaattgcactcctgcaacgtctagcttctcttgcgagacctcctggttgccccttagactatttaaaaagaacgacatccttttcttggtgcactttaatattatacgggagctccgatatctatttcagcaatatagactacaatcaactttgctgttcttactttttagttaacttttttcttttcattctgccgctaatctacaaactcgttaccctactagtacataaaagaagatcagaatcgatgggtatttatttatatttgcaatattatttatttatacaatttattgttttaatagggtatcgttgtagtgagtagtattccagtcccagtagaaggtcaattcggtgacgttactgacactgctgacgttacagacctttaggaagtcagtaccagctactctcttttcagcatagtcgtagaaatcattgatttcacaagagaaccctgggccggtggaacaggtttcaattggaacgacagcatcgttaatgacgtatctgacgtaggtgtcgttagaacattggaatttttcggtgtagacacgagcaccttgaggaacgtaccaggacttatggaaggtgttgcccatgaatggaacgtattcggcagttaagttgtttttgtcgtcaattataccagcggtggtcaaatagtttaggatatcggtatcgtgggtaaaactcaaccagacttttaagtcttgagtttcactttgctttaacaacttcaaagtagcgttaaacaagttggcaccgacggatctgatcatatcataacctggtccatcctggtaaaacgataccaggtcctggccgtatgagtaacgtaccaattcatcttcggtgaagatatcacaaacatcactgtagcctctagcgttcaattcgtatgcacaccatgcaaacaaagtgttggcgtcctttgaggtcaaattcaaacccttgttttctttgtttaatctcttggcaatgtcatccaagtatgtggtatcgtatttgtccaaaatgtcatcgttagcatcttcatcccatcctgggcacgcattaccagcactcaaagtgtttgcgccggcggacatggcttcactgacagtctgcaaggagatgttgaattggtcacctaaaccatcaatgaaatattgagcagtgtcatgaaccctttcagaactagcggcgaaaattgggaaactggtttgattttcgaacatgtagccatattgcgctaaaaactcacgagcatgtctcttagcatccatctcaccagtgtatggattcaaaacattgtctgagttggcaaaagtggtttccatttccaaatcatcgtcatcacggatgaaaaactcgtaatcatcgttcaagaatgacaatgagccgttgaattgacgtgtgtaattgctcaacttataccatgttttcatgatggtagcacctttactgtaagttgggtatctttcaccatgtctggcaagcatttgcaattgtttcatttcacaaccttcaggcaagtcacgagaaataccatagtcgccagggaaagagaagtatggcccggcaccacccaggaatgggaatatgtcttcctgagtgccaattttggcaacatcggctaactctccgaggggaattgtacctgcattaactaaagcagcggctagaaccgaataaacaacagacttaaacataggtaatttggaatggccctttctttactgtagtattttttttatgataatcaaggcataattgacttccatccagcaaatttaagcacttatatatgttgcataggactactcaaagctgtttactatttcccaaactggtattatttagtaaatttcttttgaattttttttttttcactcttcctttttttcatttttgcgatgccagttctttgagtttcccttatacggcatatgcacttaaggtttgattttgctaattaaaggcgtgcctaagcggcgactaatactgtaatataatatgggttcctgactgactacagggattgaaacatccatttacctgtttcggatatctctgcagattttaatctttcggcaaaatttagataaaaaatttgggtattcgtatttagtttccaatattatttagttatacaaaactattgtctcaatagactggcgttgtaatgagtagtgttccagtcccagtagaaggtcaattcagtagagttactgacgctgctgacgttacagacctttaggaagtcagtaccggctactctcttttcagcatagtcgtagaagtcattgatttcacaagagaaccctggaccagtggaacaggtttcaattggaacaacagcatcgttaatgacgtatctgacgtaggtgtcgttagaacattggaatttttcggtgtagacacgagcaccttgaggaacgtaccaggatctgtggaaagtgttgcccatgaatggaacgtattcggcagttaagttgtttttgtcgtcaattataccagcggtggtcaaaaagtttaggatatcggtatcgtgggtaaaactcaaccaaaccttttggtcttgaatctcactttgctttaataatttgactgaggcattgaacaagttggaaccgacagacttgataatgtcgtaacctggaccctcatggtaataagtgtgcaagtcttggtagtaggagtaatggactaattcatccttggtgaaaatatcacagacatcactgtaacctttagcgttcacttcaaatgcacaccacgagaataaagtactagcgtcagttgaggtcaagttcaaacccttgttttccttgttcaatctcttggcaatgtcatccaagtaggttgtgtcgtattcatttacaatgtcatcattggcatcgtagtcccaagcaggacatgagttacaagcactcaaagtgttggcaccagcggattcagcttcactgacagtctgcaaggtgatgttgaattggtcacctaaaccatcaatgaaatattgagcagtgtcatgacatctcttagaattagaggtaaaaacggcgaaactggtttggttttcgaccatgtaaccgtattgagccaagaagtcacgagcatgtctcttggcgttcatttcaccagtgtatgggttcaaaacatcgtccgagttggcaaaagtggtttccatttccaaatcatcgtcatcacggatgaaaaactcgtaatcatcgttcaagaatgacaatgagccgttgaattgacgagtgtaattgctcaacttataccatgtactcttgatagtcttagccagactgacagtagggtatctttcaccatgtctaccaaccatttgcagttgcttcatttcacaaccttcaggcaaatcacgagaaataccatagtcgccagggaaagagtagtatggtccggcaccacccaaaaatgggaagatatctttttgggtaccaatcttgtcgacatcggctagtttgcctaagggaatggtacctgcattggccaaagaagcggctaaaattgaataaacaacagatttaaacattggtaatctcgaatttgcttgctctatttgttgttgttcttattctcatgagagatgaagccatactaacctcgacttagcaaaacatcagcgcttatatacgtttcatttcgacaattcaaagatgtttacccttatcccaaatgggtatatgccttgccaagtaaggtgaccaatttgataatttggcatgtgcgatctcttcgaaaacagggaccagaatcataaatttagtctgtgctagtcccacgtgtgagtgccaaggttgtatcgattcatttagagattgcctattcaattaactcttttaatcacttttactttttttggcattgtgcagttgcgttctatgcgaaaacgtgctaatttaatatatatttctttgtgcagacaaagaaaaagcgctatgaaccttttaccttcgtttgaagtttatagacgacgtccgcttacatgagaaaacattaaagcagcgcacataagatgacttccaaatacgttgacatatttgcgcattcttgttgaatacaactttcggatccttgtaatgccggtctccggcgtcctgtaaagagagcgtgcgacacgccgctattagcgtggggactgacatcaggtcaacattattattgtagcgagctactttcggtcagtaaatagaacatatgtagagatacaagcgattattagaaggagcggacctacaacaaagttgggtcacgtttctcgcaattattacttggatgccctcctagctaatgccaatgtgcagtagtaacttatcagtccgatgtgtaaaaaatagaactaattttttgcgaaaagatggacaaaaaccatctctggtcaattttctcactaaagagggacggagtctcttgttttcttctattagtgcacagggaatgttttgattttccctttttttttctttcgcttcttcaacagtggtaaaaataaaaattattggcgatgggataaccaaggaacattgtatttagcaattgaaaattacggtaaaggcagccgctctgacttgatctctgacattaaaaattcggaaacaataaatatttcttttaagatgcgggttttaataactaacgatgatggtcccttaagtgatcagttttcaccatacattagaccttttattcagcacattaaaagaaattatcctgaatggaaaatcacggtttgtgtacctcatgtccagaaatcatgggtgggtaaggctcatcttgctggtaaaaatttgacagctcaattcatatattctaaagttgacgctgaagacaatactttttggggcccatttatccagccacaaattaggtcagaaaactctaaattaccttatgttctcaatgctgaaattccgaaagatacaattgagtggatattaatcgatggaactccagcatcgtgcgcaaatatcgggctgcacctattgtctaatgaaccgtttgatctagtactgtcgggtccaaatgttggtagaaatacatctgctgcttatattacctcttctggtaccgtaggaggcgcaatggaatctgttattactggaaatacaaaggccattgctatttcttgggcctattttaatggattgaaaaacgtctccccacttttaatggagaaggcctctaagagatctttagatgttatcaaacatcttgttaagaattgggacccaaaaacagatctatatagtatcaatattcctttagtggagagtttaagtgatgatacaaaggtttactatgcaccaatttgggaaaatagatggattccaatattcaacggccctcacattaacctagagaatagctttgctgagatcgaagacggtaatgaatcatcatcgatttcctttaattgggctccaaaatttggggcacataaggattctattcactatatggacgaatacaaggacaggactgttttaactgatgctgaagttattgaatccgaaatgatcagtgtcactcccatgaaagccactttcaagggtgtgaaccaccttcttggagagttgaaactgactgaggaagaaaataatttatcaaaaacaaataacctcatcgtggtaagtatagacccaatggaatatatatacaaacctctaacccacgccctgaaaaaatatctgccacaagtggagattgtatcaaacttgccagaatttgacaatggagggtgtgaaaaagaaatgaaggtttttcattacggtgattacgaacagctagatatggacaaactaatggaactgcccaataattacttcacaaactcttatatatataggaaggcattgataagaaaacactttctttcgcataccatacagacttatactgcgaagaacccagagtccattttaaagaaggcatatttggaatcattcactattgatttagattatcgtgaatttctagacgacgcattagatgaaaattgggaattacgccaagagttggagaatgaaagccaagataaatggtggatcgtgaaaccgagtatgagcgataaaggtcaaggtatcagggtatttaagactattgaagatttacaggctattttcgattcctttgacgatgaagacagcgaagcagaagagagtggaaatgacgacgatgctgatgatgtaaatggcgaattcatggataataacaaggttaacatttcccaattgcgccactttattatacaagaatatttaaccaatccgttactattggcatctatggataatagaaagttccacataagatgttacgtcgtctgtaggggagatttgcaagtttttgtttatgatagaatgctagcgctctttgctgccaagccatttgttcctctagatccatatgcgtattccgtaactgatttgaaagatttggaatgccacttgactaacacatgtctgcagagcaaaaagaaggataaagattcttctgttttggagtttgactccatagaggaaattccaaatgagagaaagtccaatattaaggagcaaatccatagcataacgaacgacgttttcttagctgctgtaaatgtaaatagattaaacttccaaccgttaccaaacgcatttgaaacatatggcgtagactttttgattgattcgaattacgaagttaaattactagagatcaacgctttcccagacttcaaacaaactgggaaagatttgaagaacctcattgatgaattatttgatgacactgtcaaatactgtgttacccccatctttaacgagaatagaaataagacagatgatgaaacagacccgaacttcgtaaaagtcattgattacacttcaaacggttggtgaaacaaaaaaaaaaaaagaacccatcctaaaatactgttattattactaaatagtgctaaataatacatatgccttgattttatttccgaaattttttgttttgtcaatttaggctctattagcttcttcatcaggttcattatcgtctacaacaccgtcttccatggtattttcaatttcttcctcaaaatttgttgtcttatttgttgtagcactgatcagacctctcttcacaacacgtagagccaccgggatagtaatatcatcgtcagatatacccaaatattcccgactccaatttaaaatcctacctcttattctattggcttttattacagactttctgattttttgtaagtttcttatgaattctttattcctctgtagtgcaatctgcgacagctgtcgggcagactcaatttcctcatttaactgttgttgttcggccgctgttaatgttgatatagaagcagaaccggaagaagatggcagcaacgataacagcgcattagattgttccaaccttggcaatgcaaaaaaaggatcttcctctccaaattcttccatgccattattgatatgaccagcttcagtagacaaactattcgagttaacctcgttgatattgtttttgttgttaatgtcatcctcgtcgcttgcccctctatcctctggaagggtcaaattgtgattataagatggtaggttcaagttagattcataaattggttcaggatgatctcctaaaaaaacctccaaaaactgggaatatctaacaactgacatctgttctttttcaatcattagaattatttgcaaggctaaatttttcaaaattgggcttgaaaatgtccttgagatagttttatgatttattatatcccctagggaaagaatgggagtcaaaatctcctttacattcactagttttgataggtcgtcatcgtcttcttcgccgtaatactcatcagtgatattttcgtcttccttctcactaccatcgatgtcgttttcatcaccgactaaaacaggctcgacgttgatgtcaggtgtgaattttattcttttgcgtctactatcagtgacaatatttgtttgcagaaggcgatgctccgaaccgttatagaacacagtttgctcaatcattggcttagaattgttcaagtctcttcttgttactacttcgcttctctgcaaaagtttgttacctctgttagaggatatgccagtggcctcaggatagattagttttccatcaagggatcttttcagtacctgatagttaccgcttttttcctttattatccttctagtaaatgtgctaattatattcgattcattagctaacacactcttgctttccaattctgcgttgtttttcatactgctcctaatagtcatctcgatcaacaagaagcaacagctgagatatttgtttctcaacctcttttttgcaggagatgctgtcatcaagcaacgtttcttctatttgaaagcgattgttttaccagaacaaagttcgctacccggcttcggtcctcttgggtataggagacaataatgatcttcgaataacgccgttataaagtgaacattataattatccgcttaaaggctttttagtaattttgtaaaacaattgcttctaatttcaagacttccaaaaggtttctcgagtaactagtgctttccaatatctacaacaaaataaaataatagaataatgggtgtttgcactatttttaggtggctctttgctgcttacttgctctcttcatataagtcgcttcctggggcatattttgttaggttttattattatgttattcaaaacttgttcttgcctatgtttacagggtttgaaaccgagaatattaagaaacttgagaaaaatgaatatggctgtttctcgtacaccagcctagatacctatgcctctccattcgaatgtgacttctactttcataagagcaatagcacctattttgcggaattggacatttcaagaggtaatctcatgtgcaagatttttcaaaaattgatgctgaattccaagcattatccatatattccagttgcgaacgttttcactaatttcttgaaggaaatcaagccttttcaaaagtactcggtttcatcaaggattatctgttgggatgagaaatggatttacgtcatgagtagattcacaattaaaaagggcaccgtcttatgctcattatcattgaccaaatacgtccttaaggacggtagaaagaccatcaaaccaaaggatgctcttgaatactgtggtttatataatgagaaggtcgccaaaatttctgaggacaatctaaagcttttaaccgagcgttgtggtttccacgagacagtaccattggaaaacttgagccaagagtactgttcagaaatctaacttctatacacatatagccggtattataaaatatataaatctatcttctttcaaaagtttctctgtgcagtctgcgttatattttatcttcggtagaaaacaaggtaaatttcccttatttttcaacatcataaaaatgaaaaacagatatatcttaagtaagatacttaagcagacaagttgaattggagaaatacaaaagctgtaaggttatcaaaaaggaaggcatacagtataatgggggcacaattatcactagtggtccaagcatcaccttccatagccattttttcatatatcgatgtcttagaggaagtacactacgtttcacagttaaactcatcaagattcttaaaaacatgcaaggcactggaccctaacggcgaaattgttatcaaagtgtttattaaaccaaaagaccaatatagcttacgaccttttctccaacgtataagggctcaatcgtttaagttgggacaactaccgcacgttttaaactacagtaaattgatcgagacaaatagagccggctacatgatacggcagcacttaaaaaataatttatatgacagattgagtttgagaccttacttacaagacattgaactgaaattcattgctttccagttgttaaatacattaaaggacattcataatctgaatattgtccatggtgatataaagacagaaaatatcctagtaacaagttggaattggtgtatattgacagattttgctgcatttatcaaacccgtatatttgcctgaagataatccaggtgaatttttattctacttcgacacctcgaagagaagaacctgttatctagccccggagaggtttaactctaaactttaccaagatggaaaatctaacaatggtaggctaactaaagaaatggacatatttagtcttggatgtgttattgcagaaatatttgctgaaggaagacccatcttcaacttatcacagctattcaaatataaaagtaattcatatgacgtaaacagggaatttctcatggaggaaatgaattctaccgatttaaggaacttggttctagacatgattcaactagatccatccaaaagactttcatgtgatgaactactgaataaatatcgtggcattttcttccccgattatttctacactttcatttatgattatttcagaaatttggttactatgacaacaagcacaccgatatcagataacacttgcaccaatagtaccttggaagacaatgtaaaacttttagatgaaactacggaaaaaatatacagagatttttcccaaatatgtcattgtttggactttcctttaataaaagacgggggtgagattggttcagaccccccaattttggaatcttacaaaatagagatagaaattagtcggtttttaaacacaaacttatatttcccccaaaattaccatttagtcttacagcagtttaccaaagtatccgaaaagataaaatcagttaaagaggaatgtgccttactctttatctcttatttgtctcatagtataagaagtattgtttcgactgctacgaaacttaaaaatttagaactattagcagtatttgcacaattcgtttctgatgaaaataaaattgatcgagtcgtaccttatttcgtatgttgttttgaagatagtgaccaggacgtccaggccctatctttgttaacattaatccaggtactcacctctgtaagaaaattgaatcaattgaacgagaatatatttgtggactacttacttccgagactgaaaagattacttatttccaataggcagaataccaattatttaaggattgtgtttgctaattgtttgagcgacttggccattatcattaatagatttcaagaatttacatttgctcagcactgcaatgataactcaatggataacaacacggaaatcatggaaagcagtaccaagtattcagcaaaattgatccaaagtgtcgaagatttaactgtctcttttttaacagataatgatacttatgtaaagatggcacttttgcaaaacattcttccactttgtaaattttttggtagggaaagaacaaacgatattatactgagtcatttaataacctaccttaatgataaggacccagcattgcgagtttccttaattcaaacaatatccggaatatcaattcttttgggtaccgttacattagaacagtatattttaccattgttaatccagaccatcactgattcggaagaattagtagtgatcagtgttttacaaagcttaaaatctttgttcaagactgggttgattaggaaaaaatattatattgatatatcaaaaacaacatctcccttgttgttgcatcctaataattggataagacagtttactttgatgataattatagaaattattaataagttatcaaaagccgaagtgtactgcattctctatccaataataaggcctttcttcgaatttgacgttgagttcaacttcaaatcaatgataagctgttgcaagcaaccagtgtcaagatcggtttacaatctattgtgtagttggtctgttagagcgtcaaaatctttattttggaaaaaaatcatcacaaatcatgtagattcattcggaaataatagaatcgaatttataacaaaaaattactcaagtaaaaattatggatttaataaaagagatacgaaatcaagttcctcgctgaagggtattaaaacatcatccaccgtctattcacatgacaacaaggaaattcccttaactgctgaagacataaattggattgataagttccacattattgggctaacagaaaaagatatttggaaaattgtggctttgaggggttatgtaataaggacagcgagagttatggcagcgaaccctgattttccatataataatagtaattaccgtccattagtacagaactcaccacctaacctaaaccttacgaatattatgccaagaaacattttctttgatgtagagtttgctgaagagtcgacaagtgagggacaagattctaacttagagaaccaacagatatataaatatgatgaaagtgagaaagatagcaataagctaaatattaacggtagcaaacagctatctaccgtcatggacataaatggatcactaatattcaaaaataagtccattgccactactacttctaatttgaagaacgtttttgttcagttagaaccaacgtcctatcacatgcattctccaaatcatggcttgaaagataatgcaaatgttaaaccagaaaggaaggtagtcgtcagcaacagctatgaaggcgacgttgaaagcatagaaaaattcctatcgactttcaaaattttacctcctctgagagattataaggagtttgggcctattcaagagattgtacggagtccaaacatgggtaatttgaggggcaagttgatagctactttgatggaaaacgaacccaattctattacgtcttctgctgtttctccaggagaaacaccctatttaataacaggttcagatcaaggtgtaatcaagatttggaacctgaaagagattatcgtgggcgaggtttactcttcttctttaacttatgactgctcctctaccgtaactcagataaccatgattcctaactttgacgcgtttgccgtttccagtaaagatggacaaataattgtattaaaggttaatcattaccaacaagaaagtgaagtcaaatttttgaattgcgaatgcatcaggaaaattaacttgaagaattttggtaaaaatgaatacgcagtgagaatgagagcatttgtgaatgaggaaaaatctctactagtagcattgacgaatttgtcaagggttattatatttgatattagaaccctggagaggttacaaattatagagaattctccaaggcatggtgccgtttcaagcatctgtatcgatgaagagtgttgtgtcctaattttggggacgactagaggtattattgatatatgggatatccgtttcaacgtgctgataaggagttggtcctttggggaccacgcaccaatcacgcatgtggaggtttgtcagttttatggaaagaattctgtaattgttgtaggaggtagttcaaaaacatttctaacaatatggaattttgttaaggggcattgtcagtatgctttcataaattctgatgaacagccatctatggagcactttttaccaattgagaaaggcttagaagaattaaatttttgtggaatcaggtctttaaacgcactaagcactatctcagtatctaatgataaaattcttcttaccgatgaagcaacaagttccattgttatgtttagcctaaatgagctttcttcttctaaagcagtaataagtccttcaagattcagtgacgtttttattcctacacaagttacggcaaatctcacaatgttattgagaaaaatgaaacgtactagcactcattcagtagatgattctctatatcatcatgatattataaattctatatctacatgtgaagttgatgagacacctttgctggttgcttgtgataactcagggcttattggaatcttccaataattttttttattttattcagcttctttattctaaatgcgtataaatttgtattcaccttaaacattttcgatcatttaggaaagggcttgcaacgcgttgaagtacccttttcacgaaaaaaatggttgtatacgtaaataaagaacaatgtatggattatggtatagaataatagtagtcacatattgcagctagttaaatgagccagatcgttgattttgttgaggacaaagattcaagaaacgatgccagtattcagatcatcgatggaccctcaaatgttgaaattatcgctctctcggaatcaatggatcaagatgagtgcaaaagggcacatgtaagctctgcagagatgattccatcatcaccgcaaagaaaatctgtttcgaatgatgttgagaatgttgacctaaacaaatctatcgaactttctgcgccgttcttccaagatatcagtataagcaagctagatgacttttctacaacagtaaattccatcatagattcgtctctcagaaatgagaataatgcaaaaggaaacgcgaaaaaacttttggatgatctaataagtgatgaatggtcagctgatcttgagtcgagtggaaagaagcacaacaaatcacaatacaatttgagggacatcgcagagaaatggggagtacagtctttaaaaaatccagagcctattgctgttgactgcgaatataagacacaaggaatcggaaaaaccaatagtgacattagtgatagtccgaaatcacagataggagcagctgatatactgttcgattttccactgtctccagtaaaacatgagaacccaactgaagaaaagcacaattcgattgctaatgaaaattcttcaccagataatagcctgaaaccagcaggaaaacaaaatcatggtgaagatgggacatccatggcaaaaagggtatacaataaaggtgaagacgagcaagaacaccttccgaaaggaaagaagagaaccatagcgttatcaagaacactaatcaacagcaccaaactacctgatacagtagaactaaatctttctaaatttctcgattcctcagatagtattactactgatgtactttcaacccctgcaaaggggtctaacatagtaaggacaggtagtcaaccaatctttagcaacgctaattgttttcaggaagcaaaacgctcgaaaacattaacggctgaggatcccaaatgtactaaaaatactgccagagaggtatcacaactagagaattatattgcctatgggcaatactatactagagaagactcaaaaaacaaaatacgacacttgttaaaagaaaacaaaaatgcttttaagcgagttaaccagatatatcgagataatataaaagcacgctctcaaatgattatagagttttcgcctagccttctccagttatttaaaaaaggagacagtgatctgcaacaacaattggcaccagcagttgtgcaatcaagctataacgattctatgccgcttttaagatttcttcgaaaatgtgacagtatttacgactttagtaacgatttctattacccctgtgatcccaaaatagttgaagaaaacgttttgattctatattatgatgcgcaagaattttttgaacaatacacttcacaaaagaaagaattatataggaagatacgatttttctcaaagaatggaaaacatgtgattcttatactaagcgatataaataaactcaaaagagctattttccaattagaaaatgaaaagtacaaagctagggtagaacaacgattgtcaggaacagaagaagctttaagaccgagaagtaaaaaatcaagccaagttggaaaattagggataaaaaaatttgatttagagcaacgattgcgcttcattgatagagaatggcatgtcaaaatacatactgtaaattcacatatggagtttattaattctctgccgaacctagtgtcattaattggaaaacagcgcatggatcccgcaattcggtatatgaaatatgctcatttgaatgtaaaatccgctcaggatagtacagaaacgctaaagaaaacctttcatcagatagggagaatgcctgaaatgaaggcgaataatgtcgtgagcctataccccagttttcaatcattacttgaagatattgaaaagggaagactgcaatcagacaacgaaggtaaatacttgatgactgaggcagtagaaaaaagattgtacaaactgtttacttgtactgatccaaatgatactattgaatgatgatcgaacgaaactttgtatataagaacataccttaaggcagtcgttttgaaaatcactgcagctctatttccccctccttacctttttaatgaattccattttacagaaagtactattgataaatattcgtaataaaataaaacagtgttaataataaatgttcgagattccggttaaagataatatgaaatggtgaatgtaatatcattttatttctacggacgtaatcataatacatactttacggctaaataatcgtcttcattaagtctgtcctttagaggctcgatatgtttgtaaccttcgttcaatttgtgcaattcctgttcattaaattttattccggaagatatcaggtgagagagaaaagacagaactctatctatgatgttcaagttactctcgtcagacaagcactcaatcgtactttcaattactccatcctttctcagcacactgattatattttcatcaatcttaacagatgacaaatatgcggtcaataaggcaatggctctcattttcagttttggtttggcggtgttatcacttaatacaggtgctatgcagtcgagcccatttaatttgaaaaacttttctgagatatctttgtggtttcttattagattagatagtgcgtaaaaagcttttgttctcacgtcgagtggctttgtcttgtcactagctatttcgataaggcttcgcagaccattgtcgtatttcatgaaattattttgcgaatccaagttgttttgcacagccgttccaataatggataaagcagcagcacgtagttcttcatccttcgtctgaacaagaacatccaacaatggctcccacagttttaaattttcgatattattagcattatctaagttctcaatcaacatttcaaagttgtcaaatgcaacgagttttgtttctaagtcaacctccggattcataataacagccatggattctttcattaaggttggatcgtcaggaccaccaccaccgaataactgctgtagcaatttaggatcaggttggccggccctagccatagcttctttgtccccttgagaattcgcaatagaccactgtaatagcttttccatagttatgtatgtgtttttttttctattttactctttcgttgaaaggtaatggctttctgactgacgatgagtgctcttttagatatagccaatcgctggtttataagcaaatttctgtcagcgcgagatgccttcctcttttctaacctccaaaaaacttccagaagattccagtccaagaggtatatcatttcaaacgaataagctgattacaaccttaatagggcccaacttgaccaaccagtagctgaaaagcttacctacaaaataggaaataggttagtacactgtcgacagcagtggtataagtatataccctacctacacatcatatatattgaagtgaggtttattttctgtgatcttgtttagcgaattttatcactgttctttttgataaactcgtccaatttgtagacaaaatccaaacctacggccttcaatccatctatctgttttctggatgacttaatggaccctggggataacatttcatcattcagtaattgcttgtctatcaatttgaagtgattatccacttcgtcgctacaccaatctactaggatggaagaaatcttagccccgagttctttgaaaatatcctggaagtcctccactgtttttttaatggtttggaacctgataacagccaattgagtcaaatagttcgtaggattgtccactgatccaatctgtagaatcaaatcttgaatgaaattagatctattctgtaagaataggtcaagagcttgctctggtaatcctaacttaatcatattttcagtaccgcttttcaaatgcactatttcattcgatgataaaatgctctgagaaagtttgctagaaatggcctctcttctttgttcgatttttaaagatatcaggttaagtaacattaactcttcatcagaaattctttcagaaagatcctccaattgtgattcaatatccaataatgtttccacggcactttcaaacctaagcctagctaattcaatatctatctcttccacgccttcatccaggaatttaagcctctgggcggttgaactcatatctctggaccttggcctcgaatgcattgatagagttaggttctgcaaaagatattgatccattgcgcctgttacatttcggccaggagtgattgaaccccccatactacgtcttttgtttttgttagggcttctgttgttttctctacctggggtttgttgcgtagattgcaaatatctaaaggactctctaatacgtttagagttctcctcttctacatggaatatgtcgcacaaatcatccttagcctttcttataacgtccaacaacctagagcattcgtctgcgtctctacattcatacaaacttgaattcgaattgctaaacttgaaaagtagcctcttagtggaaaattcctcttgcgtgacagtgacatcctttaaaggatagcactggcttactataaagtcattttgcttatctcttgatttatcggcgataagtaccaaatcattcaaaatgaaaatctgtaccatctgcaagggtttaccagtggtagtatttaattccatccaattggcactattcattaaaatatgtcttcctttcgtagaattgataaacttctgagcaccttcaacgttcttaaacagctgatccagttccgtatcccaaaatttctctaatatcaagacgctcgatctgtccctcctcatgagattcccattttgtcctgctttcaaaggcggaagtaacgctggactattagaatgactttcaacattgttaaaattgccttgtctctcttgatctatttgatcctgcaattgtaaccttttttcagctattttggtgcactgatccaaaacctcgtttaaatcatttatatttgctctaacccttttaagctccaacatagcaacatttaggtcgttgtttaccgtcatgatttcgttatatgatttattgatatttaactttacttcttcttggacctgtatcgataaatctgttaaatttgaggtaaatttatcaatagtaatggcactcgcattgcctagtttatcatgaacaaaatctttagcattaaaatgcgggtttgccaacatctttcttagcgacgtgctattattgaaaggatcattactgccggaaggattgacagtatttcgcattgctgatctagcaggcaccttattataggagctgtcgttcagggagagatcggcagttgaaagatttaaactgttggaagggcctttagagcttaccgattcgttctcagtggtgaaactactattattatgactactatccacattatcattgggaactatcatgtttggcatatcaggtaggggcattgagtaatctagtgtaggtggagcataatttgtattatgaattgatagtcttctctgcattgaagttgctaccctacttctctcccttgcattgattgttggtagcgtataactggtagccggatccttgagatcactataagggttcttttttgttttttgtttaggcttagcaggcgatggaggtgtcttttgcttagcaggagagcttgcagacttctttacatgcttccaattgtttctggccttcttcaaagaaaactcaaccattttcacagtacaaatatttcaactttcagtctcttacctggtctaatatgaaggctttttgttcattcggctttgctcaaggtcttacaaatatactattaactgcagtctctagtctctttttccagtcatctattttcatggagcggaacttagcaaacgagaaataaacaaaaatgattaggaatgtattcatgttgaaaaggttatgagatatcgaagaccattcgttttgatttgcaattagtgagaacaatttaaacaccttggtgcgaaattgaaggtttttttttccaaagaagtgtacagcccacactaacaactgctaactcagataaaaataacagaaacaaaaaaaaggtagggaaggcccatcacacggaaaatgagtataacaagtgaagaactaaactacttgatatggaggtattgtcaagagatgggacacgaggtgagtgcattagcattgcaggatgaaacaagagtattggaatttgatgagaagtataaagaacacattcctttgggtacactggtgaatctagtacaaaggggaatcttgtatacagaaagtgagttaatggttgatagtaaaggtgatatcagcgctttaaatgaacatcatctttctgaagatttcaatttggttcaggcgctgcaaatagataaagaaaaatttcctgagatctcttctgaaggaaggttcactttggaaaccaattccgagagtaataaagcaggtgaagatggcgctagtactgttgaaagagaaacccaagaggacgatactaattctattgacagtagtgatgacctagacggatttgtcaaaatactgaaggagatagtaaaattagataatattgtttcctccacttggaatccattggatgaatctatactcgcatacggtgaaaaaaattctgttgcaagactagcgaggatagtagaaaccgatcaagaagggaaaaaatactggaaactcacgataatagcggagttgagacatccttttgctctgagtgcaagtagtggtaaaacgacgaatcaagtcacatgtcttgcttggtcacacgatggtaattcaattgtcacgggtgtagaaaatggtgagctaagactatggaataagacgggggcacttctgaatgttttaaattttcatagagcacctatagtatccgttaaatggaacaaagatggaacacatatcatatccatggacgtggaaaatgtcactatactctggaatgttataagcgggaccgtcatgcagcactttgaattaaaagaaaccggtggctcatccatcaacgcagagaaccatagtggcgatggttcacttggggttgacgttgaatgggtagacgatgacaaatttgtcattcctggccctaaaggtgctatatttgtataccaaattacagaaaaaacgcccactggtaaacttattggacaccatggacctatcagcgttttggagttcaatgacaccaataaacttctacttagtgcctcagacgatggtactctaagaatatggcatggcggtaacggcaattctcagaattgcttctacggacactcacaaagcatagtatcggcatcatgggtcggtgatgataaggtaatatcctgctcgatggatggctccgttcgcctatggtcgctgaagcagaatacgctattggctctatcaatcgtggatggtgtcccaatttttgctggaagaatatcacaagatggacagaagtacgcagttgctttcatggatgggcaggtaaacgtctacgatttaaaaaaactgaacagcaagtcacgaagtctttatggtaaccgtgatgggattttgaatccattaccaattcccctctacgctagctaccaaagcagccaagacaatgattatatatttgatctgtcatggaactgtgcgggaaacaagatttctgtagcatactcgcttcaagaaggttcagttgtagccatataataactaggtacagtacataaacagatgaattttatcattcttattgttatttctttgtttacaaaaggtgaaaagtgaaaaatttcgcaatggaaaacgtcgcgggccgcctttgagtgacgttgtgcaggaatctcgaagagtcatcactttgaagataacggccgctcgcgatgagagaagacaatgagcattgcttttttataattttttataccttgtgttaaaataagtttctttaattagttttcacctcttggatgatacaactgtaattgataaataggggtagccataaagaacagaaaaaagcggcgcaataatttcgtgtattacaattacagttagtcatgagtgaagaatttcctacgccgcagcttttggatgaattggaagatcaacagaaagttaccacgccgaatgagaagagagagttaagttctaatcgtgtgttgaaggatatttttgcgggtaccatcggtggtattgcacaagttcttgtagggcaaccgtttgatacaacaaaagttaggcttcaaacagccaccacaagaacaacaacgttggaggtattgcgtaacttggtaaagaatgagggtgtgtttgcattctacaaaggtgcgttaacaccgttattgggtgttggtatatgtgtctcagtacaatttggtgtgaatgaggcgatgaaaagatttttccaaaattacaacgcttctaagaacccgaatatgagctcacaggacgtagatctttcacgttcaaatactctgccactatcccagtactacgtttgtgggttgacaggtggtgtagtcaattcattcttggcatcgcccattgaacaaataagaattcgtttgcagacgcaaacatctaatggtggagacagagaattcaaaggtccttgggactgtattaaaaaattgaaagctcaaggtggattgatgaggggtttatttcccacaatgataagagccggacatgggcttggtacatattttcttgtctacgaagcattggttgccagagaaattggtacgggactaacaagaaacgaaattcctccttggaaattatgcttatttggtgcattttccgggacaatgttgtggttgacagtatacccattggacgttgtgaaatccattatacaaaacgatgatttacgaaaacctaaatacaagaattccatttcttacgtagcaaagaccatttatgcaaaagaaggtatcagagcctttttcaaagggtttgggccaacaatggttaggtccgcgcccgttaatggtgcgacattcctgacgtttgaattagtcatgagatttctgggggaagagtaggagagtatatatgaaaacatcgttttatagatatagacatagacatgctgttatcataccaaatagaaaagtgtacagtcttttagtgattatcatctatgtggtgtcaaactaagaaattatatcgatcgttacagaatatatgatgagggaatatgcataaaaaaaaatctaaagttagtgaagagaaaagggtatgcaggtaaaaacgaatatatcacacatcaagcaaactcaaaagaacaatcactggactcgactttatttttcaaagatggtactaattccagctgttggaacttttcagcatcttgatgatagtaaaacccttgaatgttcccggtaacttgatcatggacaatgtaataaaacccatcataagatgcgccgtctacaccttccattaatagggcatctggtaccaaaaatttttccttccatttcataaatataaaccgttcgttcaagtagttgtcaaattgtttctcttggctaaaaattcttgatatgttaccagcgtctgcgcttggtgtagtaggaagctgctgtggaggcaacttcttggctgcatttgtagtgccattgtcgtcagttgagttgagaccgtttttttggctcatcaggaaaagctgtctaaaggaggggaaatttatccagtgttctaagtctgtttggtctgtggctttgaattcgtttaaaacaggttcatctttccagctagaggacaagaaccctaattccttgtggtttaccgcgtaggcttcaaaatatgtactgatttccgggtgttggttcgtgagtcctcttatcgacaaaaatccagataaatgaggggacagcgacgtgcaatctttctttggcaaatctacagtctttaagttaactgttacctgatagcgtttgtatcctgatatctggtaccctgtaaactgcattcttggtcttaagtagtttgtgcaaaccgtatggttataggaagaggtcacaatgactggattttccgaactatagggagattggtcctcaacaatatatttcttccttgtcgacccattaggtgtatgggcgagttgctgcagggaagacaacgaatccctagaagcgcacttgtaaagatcttgctcttgtaagtagcgatgacggtcatgaagatgaaagggtgcggttgaagtcaagttgaacgtgatcggatactgatttctagaaacagggggggctggtgttggttctggcgaagccgcttgctccgactgctttgatgtcacagctttgggtttctccgctacactgtctaccttaggattattgatcatgactcaagcttgcgatatgtgttggtgtcatgcacaagacgccacaaatgatagaacagaaaagaaagtgaactaatcttccaagacgaagaaaaccaaaatccgggatgagttgaaagtcaaaaagactgtatatataaatttcaacttttgtagaagatgcagaaaaagaaaatgatatggtatgcagaaaaagaaataaaccgctattatcctcgcggtttgtcattataacaggcaattacactagagaaagccgcacacctccctccgtttcttttgccctgcgagtttttccggaaaagaaaaaaaaaacgaaaattaaaacccgcctgccccgcggggtgggggaggggtcaccggaacaaatcggataatccctcgcctgccttagatatcgttctgaacggctgaaattatgaaagaagaagaacatcactttacacggatcgcacgcccataattcttttttttttttttttcatatcttcgacgtttgccactgccttctctttttctttcttttttggcggccggtggccaaacgcgccaaaaccgaaacgcttataaaatgtagttgccttgctctttcattcgatatacatataagaacgctcactgttatcttacattagaagctagaaactataacagtataacacagcacaagagaaccgagcagcccgccatgaatcctcaagtcagtaacatcatcatcatgttggtcatgatgcaactctcccgtcgcattgacatggaggacccaaccatcatcatgtacattagaattttatactgttcttccatcggtatctcttggatcatctaccaaatggccagaaagagaattgttgctaaaaacgacatgactaccatgaagtacgtcgaacctggtaatgctatgtccggcgaaggtgagaagctgcaagttactaccgtcagagactacgatttgaaggaaatagacagtgctatcaagtctatctacactggtatggctatgatgggtttcatgcatttgtacttgaaatacaccaacccattgttcatgcaatccatttctccagtgaaaagcgctttggaacacaacgaagtgaaaattcacctcttcggtaagcctgcaaccggcgatttgaagagaccattcaaggctccatctttgtttggtggtatgggtcaaactggtccaaagaccgacaagaaatctatcgaagaagctgaaagagccggtaacgctggtgttaaggctgaatgattcgatcaaaagcgaagtatttttttttcctagtttttatgtaaaaatatattcatttttttctctacgcagttgctgcagtgttataagaaaaatagaatgaaataagataaagctagacgaattgtgtctattttcctacatcgccatagaattgctttttttttcttgattagatgaaatgaaaacaaggaactctatttgttttcattttgttgggcttatcatgtaaagaaaaatgagtcgtgtcctctttttcctcgtgcttgtatgactgccgcactttccgctaagtgcgctcgtctatatgattttatgcaaatatatactgaaagttcaacaaaattaaactatgtgaacattagttcatagcagccattggcccgttgtgtcgggatctctacactaaattgtaatgtctctgggattttgtggggtgtcattgcagatatgacgaaccggatattactgataatgacgatgattcatgaaggtcttcaggttcatatgtacaaaaaaggtagagctgtggttttttattgtatcttggtgaatattctttatagtgttactcgctggtaaactgaatcgattggagtacaactgctagaactctgttcctgagacttcgtgttgaagtgacaatggattctctcattattttcgtgtgccctgccaatatgacggaagtcaacggtaatctttccaccgccatccccgtttcattataaatgtagggtacaattgcatcgttatacgggtgcatagtattaccatagccaagagccaaaccctcacagctttctctcggtatttctatactgaattgccgcaagtttttgtcttgtgtttctggttcaaaatataactttgagctaaaccaggtaatttgttcgatgttctctttcgttacgtgcacaatgctggcgtcagctaactttatcatggtcttctgttcaaattttatcggccacataatgacaccgtactctgccttcagccactgcaataccacttcattgcggttatctgtcccgcaatagcacaaaaacatcggcacctccatttttgagttccccaagaaaatgaacttagagtaagtgccctcatctaaattagagatgtccaacctcatttcgtaacggatatactcgtcagcggcggtaccaccatcaggatcactgggtactcgaatggtttgaatgtctaaatctacttccaggtttagcaattggttcaactttgctataccattttccagtgaaagttgcttgctgattcctaaaaacttccaagtataaggcattccatccaaaggaagtacgttgatacctatagacaatcaaatcaaccatgcagtcgaccagatcatcccactatggttgttgtctatttcatatcggtgtcggcatttttttttcccgtagtaccactggatctgcctaaatcgcgcttcaggaaaaccagggaccaccctatttttttatatttcatcatctaaattaagtgtatacatatatggataaagtcattttgagtttacataatcgtatgttcgagagaggtctttcataaaaaaatcaagttatcaaccagcatgggattttgggagaacaacaaagattccatcacttcagggctgaagagcgccggtaaatatggttaccaaggaacaaagtacgttgccaagacagggtataaggcaagtaagaagcactataacaacagcaaagcgcgtagggaaaggaagagtggtaagaaaaattcaagtgatgaggagtatgatagcgaagatgagatggagtacgaaagaaagccgaccgatataagaagtttaaaagacccaaagtcctttcctcccccacctttgaaacctggacaaaaaacttatacaggacaacagcaacagcaaatgccaaatggtcaggccagttatgcttttcagggtgcataccaaggccaacctggcgcaggatcgacggaacagtcacaatacgcacaaccacagtataatcagtatccacaacagcagctgcaacaaggtgtaatgccacagcaacagcagctgcaacaaggtgtagtgccacagcagccgcctatatatggagagcaagtaccaccgtatgggtcaaattctaatgcaaccagctaccagtcgctgccgcaacaaaatcaaccccaaaatgcaattccaagtcaggtatctctgaactctgcttctcagcaaagcacagggtttgtctcgcaaaatctgcaatatggtacccaatcaagtaatccggcaccatcaccgtctttccagaacggtcttcagtgtcatcagcagccgcaatacgtatcacatggctcaaccaatctcggacaatcccaatttccatcgggccaacagcagcagcccacgacacagtttggccagcaagttttaccatcacctgcacaaccacaacagcaacaacaagggcaaccattaccgcccccgcgcggtcaagtgatcttgccagcgcccggagagcctctgtcaaatggctttgggcaacagcaacagcaacagcaacagcaacagcagcctctgaaccaaaacaacgctttgttgccacaaatgaacgtggaaggagtttctgggatggctgcggttcagcctgtctatggccaagccatgtcaagtactacaaacatgcaagattcgaaccccagctatggagcttcacccatgcaaggtcagcctccagtcggtggacaaccgcctgtgcctgtaagaatgcagccacagccaccgcaaccaatgcaacagggaaacatctatccgattgagccttctcttgattctactggctcaaccccacattttgaagttactccatttgacccagacgcacctgctccgaagcccaaaatcgatattcccactgtagacgttagtagccttccaccacctcccactcatagggatagaggagcagttgtacaccaggaacctgcgccaagtgggaaaatacagcctaacacaacctcttcggcggcttcattgccagcaaagcattcaagaactactactgcagacaatgaaaggaactctggaaacaaagaaaacgatgaaagtacctccaagtcgtccattttaggacattatgatgtagatgccaacatcatgccacctccaaaacctttcagacatggacttgattctgtaccttctgagcacaccacgaagaacgcaccagaacgggcagtgccaattctacctcctcggaacaatgttgagcctcctcctcccccatcacgaggcaattttgagaggacagagtcggtgctgtcaacgaatgccgctaatgtacaggaggatcccatttctaattttttacctccaccgaagccatttagacatactgaaactaaacaaaatcagaatagtaaagcatcacctgtagaaatgaagggtgaagttttgccagggcacccctctgaggaagatagaaacgttgaaccatcgttggtacctcaatcgaaaccgcaatcgcaatctcaattcagaagagctcatatggagacacagcctattcaaaacttccagccaccaccaaaaccatttaggcgttcacaatcgtccaattctagtgatagttcttatactatcgacggacctgaggcaaatcatgggcgtgggcgtgggcgtatagctaagcaccatgatggtgatgaatacaaccccaagagtgagaattctacagaaaacggtcgtttgggtgatgcccccaacagctttattagaaaaagagcgccaacccctccggccccatccagatctgagaagttacatgagggtactataacatccgaagttgatagttcaaaagatgctaataaatatgaaaagtcaatacctcctgtaacttcgtctattcaagcgcaacagtctacgaagaaggcgcctcctcctgttgtaaagccaaaacctagaaatttttctttaaaggccaatgaatatcccaaggaacttactagggaagcaactggacaagatgaagttttaaactccattaccaatgagttgtcgcatatcaaattaagaaaaacaaacgttaatttggaaaagttaggcggttcgaaaaaagtgaaggactctagccctgttccctcagatctagatgaaaaatatgtgtctgcatcggggtctattactccaccaaggcctccaccttctaggtctagtccaaagaaagtgccgcctgttgtcccaaaaaagaatgataacctgaagaaaaagccaccagtggtcccaaagaaaaagccattactaaaatcgctcgaaccaagacctattgaaatggagagggcctattcgggagatatttctgctgctgacgataacttaaatccttttgaaagatacaaacgaaatgttgttcctcaagaagatgacagactgcataaattaaaataatgaaatagctacgcaacattgaacttaatactggctaaatttagttatccgccttggtaaacaatccgtatcctttatttaaactgtcttctcaggaacattacttatctacataaataacattaaccctgtctacgtacagtatatatttgcgtgtggttgtcaaactttagatgaaacgatactcaacgaatactataaaaccagaatggtaagggtaagatagcgggagcaaaaaatcacaaggatgcacctatttagataacaaagcagcgaattgttgaatgttgatctcgcctgatccatcactaacctctcttagcatatcatctacttcggcatcagtcaatttttcaccaatggatgttagcacgtgtttcaactcagcggcggagattaaaccatcaccgttcttatcgaatactttaaaagcttctagtagttcttgttcagagtcatttgatttgagttgacgagacatcagagccaaaaattcactaaattcgatttgatggttaccatcaacatctatttcgttcatcaaatcatttacttctgcttcactgggcgaaagacccaatgacctcatcacagtggccaattcacttgatgagatagagccattgttatctttatcaaagagggcaaaggcttctttgaattcagcaatttgttcttcggtaagattggaggacattgtacttttttatttgtattaactaagctctttctttgtagttcgatagtttccggtcaagaataagatttctatccagtcagagtacccttgtgagttaacaagatctcttgttaaacaccttcttacgcgggcaataaaaaattctaagaataaagtcatatcacagtacacgaaaatataaatacatcttgaaaatgtctcaaattgggtggaaaagagggtgcttgaattcattaggacatatggttgatgttctcaggttctacttatgtttgctttgtcgatttttgcatgctttgactgtgactttcctgtctgatatctttgtatggcttgttgctaaaacaaggtcaatccaagcagtgatcatcttgcacgttgcttcaatagaacgcgcatatagcaatcatcaagttaattggtcatatatctttcaatcagcaattagcaaagccattagagggtaattgtaacggcattttaggggctatagtcaattggtgaaaatgtttttggaaattcctcggtggttacttgccttaataatattatacctttccataccgttagtggtttattatgttataccctacttgttttatggcaacaagtcgaccaaaaaaaggatcatcatatttgtgctgggtgatgtaggacactctccaaggatatgctatcacgctataagtttcagtaagttaggttggcaagtcgagctatgcggttatgtggaggacactctacccaaaattatttccagtgatccaaatatcaccgtccatcatatgtcaaacttgaaaagaaagggaggcggaacatcagttatatttatggtaaagaaggtgctttttcaagttttaagtattttcaaattactttgggaattgagaggaagcgattacatactagttcaaaatccaccgagcatacccattcttccgattgctgtgctatacaagttgaccggttgtaaactaattattgattggcacaatctagcatattcgatattgcaactaaaatttaaaggaaacttttaccatcctttagtgttgatatcttacatggtagagatgatattcagcaaatttgctgattataacttgactgttactgaagcaatgaggaaatatttaattcaaagctttcacttgaatccaaagagatgtgctgttctctacgaccgcccggcttcccaatttcaacctttggcaggtgacatttctcgtcaaaaagccctaactaccaaagcctttataaagaattatattcgcgatgattttgatacagaaaaaggcgataaaattattgtgacttcaacatcattcacccctgatgaagatattggtattttattaggtgccctaaagatttacgaaaactcttatgtcaaatttgattcaagtttgcctaagatcttgtgttttataacgggtaaaggaccactaaaggagaaatatatgaagcaagtagaagaatatgactggaagcgctgtcaaatcgaatttgtgtggttgtcagcagaggattacccaaagttattacaattatgcgattacggagtttccctgcatacttcaagttcagggttggacctgccaatgaaaattttagatatgtttggctcaggtcttcctgttattgcaatgaactatccagtgcttgacgaattagtacaacacaatgtaaatgggttaaaatttgttgatagaagggagcttcatgaatctctgatttttgctatgaaagatgctgatttataccaaaaattgaagaaaaatgtaacgcaggaagctgagaacagatggcaatcaaattgggaacgaacaatgagagatttgaagctaattcattgagtcaatggtaactcagcctttcttttttgaaaattactattttcgactctttttttatacagttacatagtactacctctaatacacattcatgattaacaatgtttcaaacaatataaagtcccgataacgaccttttgaagtggtgacgttaccgctcttcgttgacaagattcaagagggctgtcagaataacagctatcatggtggaaagtaggtgaccctttgaacaaggcagcatatatccatcgactatcatgttcctaaaatgttatcatagccggcgttagaagatggcgcatattattattttattagaatgagttataacagtcatcaaacttagcgaaagccgaagtgtaagaactaaaaagtccactataaaaaaatgaatcacagcgtacaaaaggaaataacgataactgtgatgctatgtaaaactatcgtctttcctttgttgataaatatatcctcaaggactacttcttttatatttcttgtaggtgatgttgtgccctcatcgttaatttgaatcccagcaattatcagacagttctgccgcccttcggcaatgtccaagctgtagccaaatacttaaatcaaggaacactaaccatgtatgacatacaaggagcactaccactgatttcaacagatattaatggtagttttttgcagaatcgtaaggtagatcagtggaaatagtagaaaagggctagtttagattcaaaatttggtaacacgtaacgtcgcgctttggaaaatatacctcaatgctgactacttaagatggcaaatagccttgtcaaatttcctacggaatgttattttcattacgtccttctttttcaatgtacttattcataaatgggacactatcttgttgcaaaaggtactttgtattttggtattaacatctcgcctatttttcatacagaaacactacttatcgctatctatttgatgtggtattgcttggccatgaggataccttgagctacgttttgaacacgtgcatccaacttgtagccttgttgatccaacttaaccatttcatcaggaaacttgtgcaactcaacgctaaagcattcgataaattcattatcttccaattgagtaactggtttttggttttcaggtaaactcatatcaacttcgacagtaaccagacagaggttggtgtttgtgaaaccaggatcgttaaaaactgttgggcttttagaaattattttaccactgtaaccagtctcttcttttaattctcttaaggcagcagtgtcaatatcttcacccgcatctatcaaaccggctggcatctcaatgcatacgccctcaacgggagggcgaaactgcttttgtagcaaaatttcatcaggttttccatctttgtattttagaatggttaagataccaatgccgtctacaccaccggaacttctagtggtgcggactgcgctatcccattccctttccttcccgttgggatctttgtagatgattttttgtaaaccgatccacttgcagtcagatgtttctttaacgtgacgggcttcaattattttagcatcttctggtttacccttgacggtgctcatagttctaaatagtctccttgaattgagggaaataactcttacgtttctcaaaaacatctaagtatgagaaggaaggaaaatgccgaaagaataatcataaaagcatatatacgtgattcatatgaaggctgtctgacgttgtattaaaccgctaacggccgtacttgccatcccttacggaagtgtattcgcttgccggacctcttcctccatgaagaccaaaatgaggaattatgaaaaataaaaaatgaaaattgccataggcatggcttgaccaacacatgcgacaaaatcagaagtaacaattctggccttcactccaatgactatggatactgcgcaattaaagagtcaaatacaacaatatcttgtagaatcaggaaactatgaactgtatgataaaatattataggggttgtcttttttaaaaaatctactttactgactattcagatcaccgtcacatttattagaatttcaaacgaactaaaagccagactacttcaagaaggttgggtggataaagtcaaagatttgaccaaatcagagatgaacataaatgaatctacgaactttacccaaattttatccaccgtagaacccaaagcattaggtatgtgaatattttatcactaaatttattgaaaagagaacgttactaacagtggaatttttttttctagaaatggtatcggattcaacaagggaaaccgttttaaagcaaataagggaatttcttgaagagattgtagatacacaatgaaggatacgaaaatgcaccttaattcccaatattattacatatgctcatcgggaaaaccttttaagcaataatagattttaagtatgtaatgatacaaataataatatatttatatacgcatatatttacatgtgcatatatgaaaaataacctaattcacgttacccacctttttttttagccttttctttatttatatatgtatccacaacataatgaatgaattgtgagctacacaacatttctcgttgattataaattagtagattaattttttgaatgcaaactttttagtcgtcgtagttttcatcttcttccacttgccttactacattttctcttggaagtgtgttctcctgtggggatttttcttgagatgtttgctcttcctcacgcattttggcctcctctttcactgtttccattgtttccaaagtaggtttgattacagttatcgttgtagcagcggtttcatcttgttgtttttcagcatctctggaagctgctggctccgcctcttcagtagaaggtgcagatgcttcagttgtgccgttttcctctttagaatgctgtcttacttcgtcttctacagggcttgcttctgcaggaacagtagcagtagaaagttctatggtctcagcagtgctttggtcatttgcttttgttgttgaactttctgatgatacagttggttggacactagatgactctggttccgtattaagcggttttgtagaaggagaaacagaagctgctttggtagcttcttcagcaggactagcttcctgtggaggttcctgtgcgccaattactgaaggtattgagtttgcttttacaggtttttcttcttgtgaagtattattggtattagactccactactgctggcgattggttgctcacctcagattttgcattttcttcaatggaagtagcagtatttactaatttgttgatgtttgaatttggagagttcaacttttgcttctttacctgtggttcagcgttcgttattcctgttgcgggagcttgcgttggaatggcatgggttggttgacgaggagactttgtgttattctctgtgtgggtgctactggatacggcggcatctactaaagtgtggattgcaccttccatgtatctcttttgaggtaaaacgttctgttccacgttatgctggattaaaggttggggagcttgggcttgaggctggccttgaagttgttgtggatgttgaacagattgtagttgttgctgttgaggtggcagttgagagctttgcggatgttccatagcttgtgtagaaaatggttgcagttggtgagcttgtatgactgttggctgtgtgatatatggttgcccttgttgaggatttaacatttgcacagaaactcccttttgctgcagctgttgtcttggtaggggctgtaattgctgctgctgttgttgttgttgttgttgttgttgttgttgttgttgttgttgttgttgttgttgttgttgctgttgttgttgttgttgttgtgcctgcgcctgtgcttgtgcttgtgcctgtgcttgtgcttgtgcttgcgcttgtgcatgtgcttgtgcttgtgcttgtgcctgtgcttgcgcctgtgcttgtgcttgtgcttgcgcttgtgcttgtgcttgtgcttgagcttgtgcttgtgcttgagcttgtgcttgagcttgagcttgagcttgagcttgtaattgaggggaagctccattactgtacattgttgcagaagagttaataggcgtttgttgagcaggatgctgttgttgtaccattgaagcagtagcattggcagattgggctgaaattctagtgttcaaaggatttccttgatcattaggttgtaaggtaggttgtaaaatcacaggaggtggggcaggagaggcattcgttggcgcaccgttcgatttgtttatattgcctgggttttctaactgctttgttaaagcttctaatctttctcttatgtgaacattatttacgtccagtcttgcagcttgcttatacgcatcaagggcgtcagataattggttgttacaagtttcgtaaagagtacctagatcgtaccaaacttcactaatataaggatttaatcttatggctcttgtgtacgcgtctaaggcgtctctgtattgagaaatttggtaatataaaacaccgattgagcaccaaaagatagggtttcttgaatctctattaacagcttgttggaaagcatcatatgcggcagtataatctgttctaatcatatgcactctaccgagatggtaccatgtagtggcatcggagggatctgcttctaacgactttagaagataatccaatgccttttgagggtcataaaattgtacgttactcataccgtaaagacaacctaattgttgtaatactttggcatgatgttgattttgagccaagacatgctcgtaggcttccttcgcaccttgccactctcccatactctccaaaacactacccaactgaaaccatatgtcccactcctgcaagggagcaggaggttgagggagaatgtatctgaagcattccaaagcttgagaccatttaccctgatgtttataaataatacctagtctgaagtaaatttcgtttgccttttcaaaatgagggtccaattccaaaactttggcaaaagcttcttcggcatagtcgagcgaaccatatctgtcataaagaatgccgattccatgccataatttcggtacgttgggattactgaggtggtagagagcctgttgataggcattgtaagctctttgcagatcatccagcatcagataacaatgacctaaagtagcccacacatctgatagttcgggatttaccaaaagtgctctttcatataattctgcagctctttggaacatgtctctggaacggtacaagtgagccaaagatgttaaagcctttgcagatgagggattgaactgtaaagtggcgtcatatgccattgcggccctgtcgccatcaccaagggtttctgccaaagaagcaatggagagccaagtttccgcagttgattgtgttaatgggtcgagtggctgctgaggaactgctgcctgctgttgctgttgctgctgttgttgttgctgttgttgttgctgttgagcgggttgttccattattgtttgttcaccgcccggattcatttttcctaattttttttttccagtcgtgttttgtttgttgttgttgctgttgtagttgtagtactagtctaaaggcttatagcagtgaaaaagaaaaacagaaatatgggaaaagaggtaacgggaatacgcctctggttcaaagactagtgacgttgtcgtatttggctttgttgattctagttctctcaattgaactcctgacgtggtttgtaaaaaaacagagaacaggaaacaaaaaacaaaaagacaaagaaaaaaatgcgcttttgctttgataatcggaagggaaaagaacgaccgaccgaagaaaagaaaaataaaataaatttaaacaaaccttgttcgagttggataggggaaaaacgccaaaaaaagatggagtacagtacgcgggagaccagtggctagcgacgggagtagcaacgatcgagaaaggagtagcgcagagaaaagaaagaaaatagagagataaaataattagagccgatacggcacccgtgcgatacgagacaggacggaacagtccggtacgtgtggtaagttttacgaaacgagaggacacggcatgacatggcccacgttataaggcaatttccattttagcattggcaaacgcacaagcacaaaaaagatgtggaacaaccactaagaacggagtgtgcacgaaaaaaataagcttttctcgtgccctgagtggtgcacaaaagaagaaaagggaaaaaaaaagcgaacgaggagtgacgtggacgcgatgaaggtgactcagccaatccgggtgagccgcacccttcgtcctcagtgacctctcacgtgccctgtatcagccagccactgacagttttgtttttgccgcccagctcaaaactcagatcggatgtgctttagtttttatcttcgttatgtggatgtttcattagcttaaagcataggataccgagaaaccgtaacggtttcatgttgaccggtttttgagtttatggttttaaagttcgtcagttgttccgacgcttagattttaaggagcttgtcaaaatgcctaaaccacaatccttacagcactcaaaatcaacaaaaagtgagaaggtttgaaagtagtacatcccctcttccctttgatttttagccgccaaaactaccaacccacacagcacaaaatgtgttactcctcgaaaaaatctgttacccttttcccgccatggttgccagggaaacagtggggacttctgcgttgcttctatttttcccccctccttcctcctgcgcctccgtttctttttcttcccttttcatttcccttttcttttttttttcaagtttcggattaacgctataaaaaaaatgcacagataggaccttaaggactaataaaaccgacagtataacgacgtaatgctgcgtggtgttttcaaaccttagtagttttggtaattttagatactcttggccgtataactggtgtaccaactgaaaaatcatgcaagaagggggctttatccgtagaaggcgtacgagaagtacgaaaaaaagtgttaattataatgaactaagcgatgacgatacagctgtgaaaaactcaaaaactctgcagctgaaagggaacagcgaaaacgtaaatgacagccaagatgaagaataccgtgatgatgctacgctcgtgaaatcacccgacgacgatgacaaagattttatcatagacctaacaggttcagataaagagcggaccgccaccgatgagaatactcatgcgatcaagaatgataatgacgagataatagaaatcaaggaggaacgtgatgtttcggatgacgacgaaccgttaacaaagaaaaggaagacaactgctaggaagaagaagaaaaaaacgagcaccaagaaaaagtcaccgaaggtaaccccatatgaaagaaacactttgcgattatatgagcatcatcctgaactaaggaatgttttcacggatttgaaaaatgcacctccctatgtcccccaaagatccaagcagccggatggtatgaccatcaaactgctacctttccagttagaaggtcttcattggctaatatctcaagaggagagcatttatgcgggcggtgttttggcagacgaaatgggtatgggtaagaccatccaaactattgccctattaatgaacgatttgactaagtctccgtctttagttgttgcccctaccgtggcgctgatgcagtggaaaaacgaaatagaacaacatacaaagggacaactgaaaatatacatttatcacggtgcttccagaaccacggatatcaaagatttgcaaggctacgatgttgtactaaccacttacgcagtgctggaatcggtattcagaaagcaaaactacgggtttagaaggaaaaatggacttttcaagcagccttccgtattgcataatattgacttttatagagttattctggatgaggcacacaatatcaaggatagacaaagcaatactgctagggctgtaaacaacttaaaaacgcaaaagcgatggtgcctgtcgggtactccgctgcaaaatagaattggtgagatgtattctttgatcagattcttaaatatcaatcctttcacaaagtacttttgtaccaagtgtgattgcgcttcgaaggactggaaatttacggatcgcatgcattgtgaccattgtagtcacgtcattatgcaacacacgaatttcttcaaccatttcatgttgaagaacattcagaaatttggtgtggaaggtcctggtttagagtcttttaataacattcagacattattgaaaaacatcatgctgcgaagaactaaagtggaaagagcggatgacttgggtctaccgcccagaattgttaccgtgaggagagacttcttcaatgaagaggaaaaagatctttacagaagtttatacacagattctaaaaggaagtataattcctttgttgaggagggtgttgttctaaacaattatgcaaacattttcaccctaatcacaagaatgaggcaactggcagatcatcctgatttagttttgaaaagattaaacaattttcctggcgatgatatcggcgtcgtgatctgccaattatgtaacgatgaagctgaggagcccattgaatctaaatgtcaccataagttctgtcgtttatgcatcaaagaatatgtggaatctttcatggaaaacaacaataaacttacttgtcctgtttgtcatatcgggctaagtatcgatttgtctcaacctgctttggaagtggaccttgattccttcaaaaagcaaagtattgttagccgtctaaacatgagtggcaagtggcaatcatcaacgaaaatcgaagcacttgtggaagaactatacaaactgagaagcaacaagagaacgattaaatccattgtgttttcccagtttaccagtatgctggatctggtagagtggagattgaaaagagctggatttcaaacagtgaagcttcagggtagtatgtcaccgacgcaaagagatgaaaccatcaagtatttcatgaacaacattcaatgcgaggttttcttggtcagtttaaaggcgggcggtgttgctttgaatctttgtgaagcttcgcaagtattcattttagacccatggtggaaccctagtgttgaatggcaaagtggtgatagagttcatagaattggtcagtatcgacctgtgaagatcacaaggttttgcattgaggatagtatagaagcaagaatcattgaattacaggaaaaaaaggcaaatatgattcatgctacaataaaccaagatgaagctgccattagcagactaacgccagctgatttacagttcttattcaataactaatattttattctcttattatatattattctcggagtttttaagtgacatcacccgaaaagaagctaagtctttctcctaattcatatttaattattgtacatggacatatcatacgtaatgctcaaccttaagctgctgcggagcttccacgagcaccagcacctgaagcaactagacttatttgcgcttgagttagttctatacttggcagtggaagtttgtcattatgagttggtggaggtaaaaatccaaccttgtttaaaaatgcaatatatataccaacctcttctggagtaacacctattccattagaccaatcaacacctgtccatgcggtgtctttctttaaagatgccacggcgttcctatcgtctagttccggagctttggtactttcaggtaagttgtctaagaccatgtgtagcaaaggatacaacgcattttcttcattcctgtcaataacagacgcctccaatgatttcttccatttagaatagctttcgatttcgacatcgtaaccataatcgtgtaaagtatacaagtagtctttgaataatattcttgggtgacccgttacttgagcaacggccaattcattttctttgggaggattcaaagacgtagcaacaacaacacgagcaacatgatctactggaaccatattcacggaattttcgatatctggaatcttacctaattggactgaacctttcaaaaatctcaataagaaatcatctgtgtttgaagaaccattggcagaggcacctgttacgtaacctggtctgacaatacacccacgtaggcccctttcacctgcacgtctaatgatgtactcagcagcccatttggactgaccatatccaccagtgagcccgcttgcagagttcattaaatcgtctgattctaaaatgcctggcttcccttcgctaacaagtttatctgacaaattaaagtagtattcagtgtcaagagtagaagtggaggaaacaaagtcaaagaactttggcttgccgacggcggctaagctcataacattgatagttgaaataacatttggatccctcaatttggcatatggataaacccagtgaactaacgcaccattatggataattatatcaactgtgtttgccaaatccatccacttctcatctgaaagaccaaattggcttttagataaatcgcctaatacaactttaatatttgaggcaaatttttcgttccaagtaccataggtgatacctgccttttgtaatcttgcaaatgcagcttcttcatccttggccctgacgtgggcaaacactttgaaactgtagttctttggagaacgtcctaacaaatctgcaaggatgtaggagcccagaaatcctgtgacaccggtaacaaacacattaattgttgtttttccttcggcactattaggttcaacaaaatattctcgagaggggtacgaacttggtagcgtctcaaccaatttcttggcgtcttccgcataatttgcagtgacattttcgacgacctcaccttgagatgatccacccgatgatttaattctgtcaatttccgcggcaaaggcctttatcgttggatacttgaaaattgtgcccaatggtaaatcaacttgcagctttttctttaaggtaaaaatcattttggtagccaagatagaatgaccacctaaatcgaaaaacgaatcatctggtgatacagatgctggcttggtaggtaatatacttaaccataagtctctaacctcgcgctcaacattggtaaactgagagtcgtcagtttcagaaactgtattttcagctaccaaatttaattgcttgggagttgggaattgaagtttaggcttatcaactttaccatttggattcaatggtagtttatccataaccacaatcaaggaaggcatagcatagctagccaatcttttctttaagaaagtcctgatgtccttggataaaagatggtaaccgattaagcccttaactatagggtcagtttcaacctcctttggaacatcactttggaacttagacaagtcatctggcttgtcaaatcttgggaccataaatgtgatcaatgttggctcattgtcggcatttttgcgaactaaagtaatgttttctcttaccaatggatgttgggaaatgtgcgtatctatttctcctaattcgattctgaacccacgaattttaacttgatcatcagccctaccgcaacattcacagtcaccgtttggtagataacgacctaaatcacccgttctgtacaatctatctcttggacctaaccagaattgtctccaaggttcaccattatccttatccaaataattccagtgatctttttcaacaaaccagttgttcacaaatttttctttattcaattctggtaatcctctataaccttcggccaaaccacctgcacgaacataaatctcacctatttcgccaataccacatatttgagtacgatcgttcctgttaacaactagtagctgaacgttcaacatacctttaccagcaggcatgacatctttcaattttttcaaaaagtttggatcgtcattttttgatttaacttcgaaataagaaactgcacgctgtgtttcagtggtaccgtacatattaacaatacggcaattttctgccaaggtttgtaacctcagacaatcacgttttgttaaaatgtcacccacaaagaacgcatgatgtaacttagggaatggtgtagtagcttgggcagtaagtaattgacccatggcaggtgttaaatgggtaactgtgcaaccatacttactcatccattccgctaaacggcccggtgtaccaatatcatcttgagtagggacatacaattgggcacctaaaaataatggtgtaaacatatctctttgaattggatcatgtgcaataccgctcagcattgtgaatttatcattttctgttaagttgaaccttttggacatccaattgaaataataagccaaggaaaaatgtctaccaagaacacccttaggaataccttcggaaccagatgtgaaagatagggttgggttggaatctggtccaactacaacacctgttctggtgtctttgtagtgatcatatggagccaaaacatcctcgccattgtccaatttgccaccttcaatggtaccattttcttgaatagcgatggaattgattcttgaaacaatctccaattcatcattgatgtaatcttctactagttgatccaattgtccagcagctctaataacaatcaacccacgtggtttagcaacacctaagtaaatggtttgtctggctgggggatatgcagggtcgataactgaaaaggttgcgccggctttcaagacacccatcacacataccatcaaatccacacccctagaagaatagatcatcactacatcacctcttttgatacctgttttaatcaaataatgggcaactatgttagaagtgcggttgatgtcgcgataagtgaaagaacgggacttgtcggaatttagtgttggagtctccacaacacaggttctctctgggaaggcttcagcattgtcctggaaaatgtcgtgaatacaccccacgaaatcgcaccagcccaagttcttagttggatcaggtaaactatccttggatgatgcggtgatcagagagattttagttatgcaattggatggatcgcttagcgcagcagtcaaatattgagtaaattggtccgcaacaatggttactctttcattcgaatacagtaagctgttataaattaagttcaaaacatgcgcattattactggtatccaaattcaaagcaaagtccactaaatgatgcttgaactcgtctaatttgaaatcttggttttccaaaaaggccaaacggaacaactgaggggtcctttccagatcttggcaactttgaattttttcagctagctcgtcaaaggaaaaattggcctcaatagaattgagcttgttcaactcattgttaattgtagaatacagctcattaaatgaccacgttggttgaatattgaatcttaagattttgttattcgcaatataaagaacaatatcatcgtcaccggttactctatatatcaatgcagcccatacactcaaagcgacagcgtatttgttagaaaaactatcatgaggcacatcgagctgaggtagctgtaacgaatatgtagcttgtttcgtataaggttcttgttgtgggcgtaaaaagtcatgtggtaacactgaaagagttggattatccaacttctctatccagaccttttcgttagtcattagtgagtaactctgtgatatctctctataattagcagtttttcactgaaattccaggaaaggtaataaactcagatttttttttatactattggctgcttgttacttatatatcttgaacttctcccagcgggtcttcaaatacatttgggcgatgttcatgttcattaggcaggtatttcgacattgagtcacacgcgaaaaaccgccggaattttttatgtaattgcaagtggaattccgctggcaaaactattgaagagttttcctcgctaaaactgtgcgatgcctctagaagcggtcagcaagaagaaaatcgaataatcagtttcaatgaatatagacgtaacaaaggcacaaaaaagaaaacaagtacatatgtcatacatatatatatatttcaggcagcaagtgaccatcaaccaggaagtgtgaaatagcaaagaactgtttacttcttcagacttagaaagctcttcccataggagaaagcaactgctttcctttgtagtaattgattgtcttttcagcccttgacgcaacaccgtccgctgtgaaatcgaacaatttgtaaatttcaggccccttgcctgaacgaccaaattcgtcgagtccgaacgattgatgagcatacttaccccagcttgaagtagccaatacttcaaaggacatgatcggaacaccgtctggtagaacagagaatctgtattcttcactttgcctgtcaaaagtataaaagtctggcagggaaacaactcttgctttgatttttttagtatcgtacaattttttggctgcatctatagaaatggagacttctgatcctgttgacaccaggataatatcaggattctccacgtcatggatcacatagccacccttcaaggctttttcaaaagaggaatgctccaattgaggaagattctgtcgtgataaagccacaacagatggtgttcgaccagatttgatagcagaataatacgcagcagaagtttcgttaccatcagcaggtctccatacatgcatgtttggaatagccctcaagtgagccagagtttcaataggttggtgcgttggaccatcctcaccaagcccgatagagtcatgtgttgcaacccaaatgactggattaccagacaaggcggctaacctaacggctcctgcagcataagagacgaagttcaaaaaggtaccaccgtaaggcttgtagtttgcaccaaaggcagagataccgttcataatggcacccattccgtgttccctcacaccgtatctaatgtaccttcctgcatagttacctagttgggtaatgggaggttggaaatctaccgcgccttcccaccttgtcagattcgaaggtgtcaaatcggcagaaccaccgatcaattcaggcaaaacttggaccatgttcgtcagcacctgctgggatgtctttcttgttgccagagcatcgtcgtccggagtaaacttcggtaaatgcttttcccaaccttccggtaactcaccattcaatcttctttgcaattctttacccttctcgggaaatttggttttgtattcttcaaacatcctatcccattcctcattaagtttttgaccgggttccacaacagtcttcttataataatcgtacacctcttgaggtactacaaatgatttatttgggtcaaacccccacctcttcttcaactgtttaacatcatctgccttcaaagcggacccatgaacaccagcagtaccctgttgtagggacccaaatccaattgtagtagttaccttgattatggttggcttgtccttcgatagttttgccttttccaaagcgctagaaatggattccatatcgtcgtctcctttatcgacttccatgacttcccaaccatatgcctcgtatcgcttcaaaacatcttcgtcgaacgagtacgaggttttaccgtcaatggaaatgctattactgtcataaaacgtaatcaagttacccaattgcagatgtcccgctaaggaagaggtctccgaagaaacaccctcttgtaagcaaccatcccctacaatagcaaacgtatatgagtcggaaatgggaaagccatcctcgttataagtggcggcaaagttggcctgcgctattgccataccaacagcatttgagataccctggcctagcggaccggaagtgatttccactcccgctgagtggaattctggatgacccggtgtccttgagtttacttgtctaaattgtctcaagtcctcgatagagtaatcgtatcctaatagatggagcattgagtacagaagagcgcatgagtgaccgttcgacagaacaaacctgtctctattgatccaatgttcattgttagggttacagcgcagttgcttgaaaattacatgggcaactggtgccaatcctagtggtgcacctgggtggccagattgtgcgctttccacctggtcaacggaaagtaatcttaaagtggaaaccgcaagtttatcaatgtcggagaactgtgccatttttttgttctttttttgattagtaaggtataatcgtctacgtagaggttacaaatcgaagactacagtaagaggggacaagccaattgaatatacgactgaaataaatggaataattctgcattattacactcgtttatatatccaaacaggtgatctggtattctcttgacaacgaatgaagctccctatattcgacactccttattcaggactcctcccaacaaggagaagtaggtgttccttgagctaccctttaaagctggggagatgagcttgcccttcctgtcatcgccattatgacgagaaaagtaaaacatgtagaataaggtccacccaaacatgtccgagcaatgacgttatatatcgtgttccctgttcaaagcatggcatatgtgccattaaaggcgaatttttgtccctagcaaaggagagacagcgagccaccattaagaagtgacttgaaagcaagcgaaaatagctacacatatatatcaatatattgacctataaacccaaaatgtgaaagaaatttgataggtcaagatcaatgtaaacaattactttgttatgtagagtttttttagctacctatattccaccataacatcaatcatgcggttgctggtgtatttaccaataatgtttaatgtatatatatatatatatatatggggccgtatacttacatatagtagatgtcaagcgtaggcgcttcccctgccggctgtgagggcgccataaccaaggtatctatagaccgccaatcagcaaactacctccgtacattcatgttgcacccacacatttatacacccagaccgcgacaaattacccataaggttgtttgtgacggcgtcgtacaagagaacgtgggaactttttaggctcaccaaaaaagaaagaaaaaatacgagttgctgacagaagcctcaagaaaaaaaaaattcttcttcgactatgctggaggcagagatgatcgagccggtagttaactatatatagctaaattggttccatcaccttcttttctggtgtcgctccttctagtgctatttctggcttttcctatttttttttttccatttttctttctctctttctaatatataaattctcttgcattttctatttttctctctatctattctacttgtttattcccttcaaggtttttttttaaggagtacttgtttttagaatatacggtcaacgaactataattaactaaacatgggtaaagagaagtctcacattaacgttgtcgttatcggtcatgtcgattctggtaagtctaccactaccggtcatttgatttacaagtgtggtggtattgacaagagaaccatcgaaaagttcgaaaaggaagccgctgaattaggtaagggttctttcaagtacgcttgggttttggacaagttaaaggctgaaagagaaagaggtatcactatcgatattgctttgtggaagttcgaaactccaaagtaccaagttaccgttattgatgctccaggtcacagagatttcatcaagaacatgattactggtacttctcaagctgactgtgctatcttgattattgctggtggtgtcggtgaattcgaagccggtatctctaaggatggtcaaaccagagaacacgctttgttggctttcaccttgggtgttagacaattgattgttgctgtcaacaagatggactccgtcaaatgggacgaatccagattccaagaaattgtcaaggaaacctccaactttatcaagaaggttggttacaacccaaagactgttccattcgtcccaatctctggttggaacggtgacaacatgattgaagctaccaccaacgctccatggtacaagggttgggaaaaggaaaccaaggccggtgtcgtcaagggtaagactttgttggaagccattgacgccattgaacaaccatctagaccaactgacaagccattgagattgccattgcaagatgtttacaagatcggtggtattggtactgtgccagtcggtagagttgaaaccggtgtcatcaagccaggtatggttgttactttcgccccagctggtgttaccactgaagtcaagtccgttgaaatgcatcacgaacaattggaacaaggtgttccaggtgacaacgttggtttcaacgtcaagaacgtttccgttaaggaaatcagaagaggtaacgtctgtggtgacgctaagaacgatccaccaaagggttgcgcttctttcaacgctaccgtcattgttttgaaccatccaggtcaaatctctgctggttactctccagttttggattgtcacactgctcacattgcttgtagattcgacgaattgttggaaaagaacgacagaagatctggtaagaagttggaagaccatccaaagttcttgaagtccggtgacgctgctttggtcaagttcgttccatctaagccaatgtgtgttgaagctttcagtgaatacccaccattaggtagattcgctgtcagagacatgagacaaactgtcgctgtcggtgttatcaagtctgttgacaagactgaaaaggccgctaaggttaccaaggctgctcaaaaggctgctaagaaataagagtaataattattgcttccatataatatttttatatacctcttatttttatgtattagttaattaagtatttttatctatctgcttatcattttcttttcatatagggggggttggtgttttcttgcccatcagattgatgtcctccaactcggcactattttacaaagggtttttttgtaagagaaggagaagacagatactaaaccatacgttactcgaaacaaaaaaaaaaaaaatggaaaaagctgctatcaacaaaagacggcctcatcaaacctaaagaaaccatgtcagcgtatgtatataccttgtaatttacgtttccttaaatcttctttctactaacgttttcattattctatactctatgaccaataaaaacagactgtactttcaaaatttacccagtaggccagcaaataaagaaaattataccagattacttctgaaacacattaatcccaacaacaagtatgccattaatccgtcgctaccccttccccacaataaattacaaatatcatcacaaccgctgatgttactagatgatcaaatgggccttcttgaagtttctatttcaagatcatcaaagatgactaaccaagcatttttaacgtttgtcactcaagaagaagcagaccggtttctagaaaaatacacgacaacagcattaaaagttcaaggtcgtaaagtgagaatgggaaaggctcgaacaaattcgttattgggtctttcaatagaaatgcaaaaaaaaaaaggtaatgacgaaacgtacaaccttgatataaagaaggtgcttaaagcaaggaaacttaaacgcaagttacgtagtgatgatatatgcgccaaaaagttcaggcttaaaaggcaaataagacgcctgaagcataagctgagatcaagaaaggtagaggaggctgagattgataggattgtaaaagaatttgaaacccgtagattggaaaacatgaagtctcagcaagaaaatctaaaacaatcgcagaaacctcttaagcgggctaaagtgtccaatacaatggaaaatccaccgaacaaagtccttcttatacaaaatttgccaagcggcactaccgagcaattattgtcgcaaatacttggcaatgaggctttagttgaaatcagattagttagcgttcgtaacctagctttcgtggaatacgagaccgttgctgatgctacgaaaatcaagaatcagttaggctccacttacaagctacaaaacaatgacgttaccataggatttgctaagtagaatttcctttgcggaagtatacctcgagtaaagaaattcacagataaatttgaataacgttctccattatgaataaatatgtatttacaagcttagaaaataatgtgctctttatttaccaaataatacagttctcattgcagtaaataagctttcctttttcttaccgtcaacggcatttattaaccgttgataatattggggatttcctgcaggtttatagagcttatcgccaatatcgtaatagtttctgaatttattattcattatagtgctcaaggcacgaatttgctcgttgatgctttcttccgtgaatttctcatctaccattttattttgaattttggttaacatctccttattcagtcctaatggaccggaagttctgttaattatactttttatttcatctaatgagggttttttctcttttatagattttcctttgtcatctacatttggcagacccgctacacgtctaaatcttgctatttgtacatccctgaatgagaccaagtggtgtatacgatcctttggatatttttccagtaaattaactaattttttggcagaatccctgacgacctgggaagaagacattttggcacttgcttgtggaatacggagtttaacttggtaagctgatagagagaatgtttcaatgaaggctacctttttttcttataatgttgctaccacaggaaatcttgatatacgttaatgttttggcccctacaaggccggaaatatttcgctttttcttgatatcagaatttttcgcatgtccgaccatgcgcagagctgctatgaaagtactttaactattagtgtgaggaatggctaaataaacagcagatgtgatttccgcacttcttttataaacttccaaaataatcgtattagtggacagtacataatcatatcttgcaatacgtatcaatagtaaacgaattatttattcatacacacatgtatatacttctcgcttctttttttaatttacatgtttggcgatatatagttaaaattaagtcatttatttagtcagtttcagcttcagcttcagcttgggcaataaaaggagtcaaatccttggtaccttcttcccaagaagcaccattgtaagtgatatcgcggatagccttgatgacattttcgacggaacctctaacttgcttggtggaatctctttctctcaaagtgacagaatggtctttggcagattcaaagtcaatggtgacaccgaatggagtacctaattcgtcattacgggcatatcttttaccaatggaaactccagaatcatcaatcttaaatgggatttgagactttcttaagattttggcgacttcatgatgaacaggaactaaatctttgtggttagataaaggaactaaaagaacctttgttggagcaaccaaaggtgggaaggaaagaacacttctggcattgtcttctggtctgttccagaaagagtgctcaaaaacggagtagatgatacggccaataccgaaagatggttcaatgacactaggaacatattctctaacgtgttcaacctttgttctttgttcgattttaaccaatttatcgtccaactcgacttcgccatcaacaccatcaacctttatagtaaacttgccatttgccttcaataactcagccttggaagccaagtcatcttgagacatattcaatagatgagattcaacttttggtgcatcttttctgaattttggaccgaacaattttttcgtcaaatcaatttcccacttggtgacttcaattggattatctaatttttgtctaacaaccaatttttctttggtctttttggaatgaacggtcaaatcataggcagatctatcagcacatccgacacattcaatccacccgtaagatgtcttcaattcaccatcccaacagtcagcagcataatgtgccatttcattagccatatgttgacggaatctcaatttggactcatcaacaccaattttcatcaaaaattggtaaattctggcaataaagtaacccaaagtttcattatcgaccattcttgaagcaactgcttcaccaactgtcttgacaattggttcagtagaaccagcttcttgaacatcacgaggcaaaaaggaaagcttgatgtctttgatttcattaaattttggatgagatttgtccaatgggtcaacgaaatgttcaatctctgccatcaaaaattcacggactcttaataaaccggcccttggggaaatctcatttctaaatgatttaccgatagaggctgaggcaaaaggggtcttactgttgttaaattctaacaacttgttaaaattcaagaattgaccttgggcagtttctggcctcaagtaaccctttaattgaccagatgggccaatagccgtttcaaacatcaggttaaaagcccttggagattctaaagtttctccggtgactgggttaccgatatcgtatttttccatcaattcacctaattctgggccggaataaccatctattttagccaaaatttcttcatattctttgacaacgtcgtcatccaatttgactgctttaatttgtttaacttttttctttctcttcttcttttcggcatcgtccttagcagcggcattagcatcctcgactaaacctctggcttcttggtcaccctttaagcgagcttccaaaacttcttcgactaaatggtcagctctgaaaatctcaccagtcttcaaatctctacacatccaatcagaaaatttgtcaacatgacctgaggtcttcaaaacctcatatggagttaacatagtacaatcaacttccaacatatcttcttccaaaataaaatgctttctccaggcgtcaatgatgttgttttggaatgcacaacctggtggaccatagtcatataaaccagaaaccccaccgtacaagtcaaaagctggggcataaaaaaatcttcctctcaaaacactttctagctgttctctgttaaatggaacagcggctctagccttcttgatatcttctacactcattcttttaatcttaaccgattttttaacaatctgagagtaaaatcgtctactgatattgaagaacgacaatttttcttgaaaatcaacacgaatgcaaaaagggaaactaaaataaaagaaatcctcaaaagtaattgaacagatttcgagtcctaattgcaagtaaaattatgtatacaaagtacgtgataagtatcgcagcagtgattcaacactcgagaagagtaaaaattttcaatttttttccactgcgctgaaatattacgaggcgtagaaaatgatcactacaatgccgttgctgcttattgcagcgtaagtgagcttcattcacagaccatttgcctcgataatccatgaatcatatctggttcatattatgtttgtaaatgtgtgtcttgttgcacttaatctatcgcgatagcgccaaaccaagcgttcgcagaatcttcgttgtcaatatatacatatgtagacgtatgtgtatatgttgcggtatatacaaggctgtttatgtagtcttcaaacagatgcgattgagatctatgtcccaaaaggaatataaattggttcgagaatagaaaagtaaggggagcaaacactattcacttcttgtctctcttcttactggccaacttacctgatttgatctgttgttcactatcgtctaacagagatagatagtcatccataccgaacgctttttcagaaacgtcttccttctcctcctttttaatctgtgttttctttttattttcttcagatagttcaactgtttcagagcttgaatttggggtcgttgaatcgacagaaaacaaagagctatacctcttgttaaatctgtccaagctaccaccagaattagcatccacaacgactaggtcatccctgctaggattccacagcggattatttctctggtcttgaattaatctaatttcaccctttggatattgggatctccggataactacacttccatcactcaactccattttgacattgaattggtgataaatagccggtcgtgacttccccagttgaattttttttgcaggccttcttggcaaagtaattcttgtagaaccaggatatgaccctgtggaagcaaatcgcttcgcaaatatagacttcaacattaggagtgaacaaaacgtgtgttcgtttgcgttggtacccgttctttctggaggcattcttaacttttaggaataataatgataccctttcattttagttatttgattttgatgcattttgcacgagataatcgctctttacggtttggggacaaaactcagaaatatcacatacgtagttatggttttattgcacatttggcatattttgatattgaaataaaagaaaacctacttattacagatcgacttcatcaacaaatcccttgagctcgcttttcattgtttccgcggttttaggatctagtttagctattttatttatgatatcttggaagctcgctgttttaacatcaaaactttcttgttcttcttcatctgcatcaacgtcatccacgtcatcgtctatacttgcaggcaccttcaagttctgatcagtgtccatctcttcattttccaaagcagcgtcgtctggctcttcagttatggcgccattatcatcaaaatcatcaccagcagcgatacccttatcctcctctatggcatttgaggacatttgactacctgcatccatatttatgtccccatcagcatctttattggtgttaacacccattccctcttctgagttcttgttttcgggtaccatggattctttaacaaataacattgtcttgaaatacttcaacttgtatttattatactcataatttccttgaaccatgcaaccaagttcgtattttactatccttcttatcttgaccaagtctaattctttgaaccatccagttagttcattcgccttatctaaatattcgacgttgtgaaaaacttctgcaatgtttggctcaccaattaataaatcaatctgcaacatcaggtaccacggtattctttttccatcaaatttgaacctgctgtcaataccgcctggagtgtctgattcgaataccaggggtggtggctttggtacattctttttcactatgggagaagatagtaatttcctttcaatcttaaaatattctgtttgatattgggcgtattccactgaacttctggggtctataccaaatttgatatatgtatttctccaaggccccattgtgaaacgataagatatgagtgccagcgctatcttcatagtatggtgtatcttcttcgggacaatcccatcaagatgtcttttaacccaaattggacgtctagcgaagagctctctcaaaattttcaagcattcctccagcgattcataaaatttagagtcacttttagtgcctggatagacttttgttttcttcgcgacctcaaaatcgtacaggacttgttcatgagcttgggacggtataactgtcttatcactaagatcatgaacaaacaactgatagtttttgatatatgttcccttcacttctgtgacaccgttttttttttttttcgcaaatggattagctttatatttataaagcagggggaaaccaaccattgataacttaggaggtggcggcagttggaaatctgtactcggaattttaacgctacggtctaagatcaaattcccgatgttttcctgaggttgagagtcattatctggtacagaattgacaaaacttttgaaattattccattccagagagccaaagctacttttgaactctcttgcagaggggacattatccagtttgatttgaaaatctgacatttctctaaattttatagtgttatctactatggaaacaggagtgactctcaatttattcgaatcttttaaggatttgatagaatctttgacgctattattatttttacttaaagttcccttaggcattgtaacctttaatatgaccgactcatctctgaagggaactcttttaccaattacaggatgctcattaaaatagctcttggatccgtcgctatcagtatcatcgtttaagtacagttgtaatccgtgctgagattcgataggtccatgttctttaaaggcttctttcactttttcgatgcccccacacatttttatagccttctgtatactagagtgttttgtggagacattaagtggcaattctaaacttggaattctgggcaggtctaacgtaaattcatctgctattaacggtggggcctggtccgcgctagaatctggaattgatgaaagtgtagcaagaggctcctccactggcattttcacgatttggaagatattttcgctcttgaaagctatagagattaattatgtttttcccttggtataccttttctgtgttgtctttcagttcctgtctttaggatgttatttatcgatctttttcagaaagaccaaaagcgaagaagcgaagaagaggacttctctgtactaagaccaaattatgtaaaaggaaaactaaacatgaatatgtgaatttatttccaaaacacagcagagcttaaagatggggtaaactcatattcatattcatatacacgtatgtatataaaaattcatttaaaaggattgctttggttttctacaacactaaaaagcacaataaaataataaagtaaaaaaaaaaatgtgataatgaggtcgttttaaggtacttttgttatttcatctcccaagcagttgatcctatacactaatacacagacacattaaccacacgttcagatatgtatgagaaaaaggaagaagaaaaataattttttttccttacactaggcccctttctctttccaaacgggtcttcattttattaaaccagtcttgcaatgtttcgcctttccggtttagcactacaatgatggcagtcatattgtcaaagccgacaccagtattgctatttgcctgcgctatcccgtggtccaacaattttgttattattgtatccaacttcgtccctgataccaggtgatactttataaagtgaattaactgtttgttgttataaatatcccatataccgtcgcaagccagtactaaaaactcatctttagaatagtcaatcttgtgcatcaatacgtctggttcaacggtaacttgtgcttcttgtggtggggttccataagttaaattctgggtaatatttgttagttttgtccttctatgtggataagtgacacctctcttgaattggaaatcactaaatgccctactgagagccagtactccacccactcttccaagagagacagtaccaccattatcgtttatacgtatcaattctcctatgtgttgtggcttatgatcgaaagacatcgtctttatgccattcgatttggaggaaagaatacatcgcgaatcaccacagttagccacatacagtgattcctcgtttatgatgcatgctactactgctgtagatccacacgaactgttggcaaaatgtcgatataactcttcatcttgcaatatgaaagcgtctttaaaaatttgagaaacaagtccttccaacgtattgaaggatcttttaaattttgatgagtcgttattagttgtagatgtgtaatggtggttttcgaaactatacgcaatccatttgatcaggccagcgttgggttcaccattaccgttgctactgccgttaccatcgcgatggtggcggccgccgcttagaaatttcgaacaatcatctccaccatgaccatcgaatactgcgaagacgttcaatgacagggtttcgtatttgtctatgaatgggttgaaaaatcgtacgtacacaacagagttttcatttctaattagatgtgcatcttcctgagtcaaacgatagccttgcatggaccccacacaattgtaaaatcgtggaacaataccagttgacgcctggttgtttttatattcattatattctatggtcttctccgtcaacggatgggaaagcaattgacccatttttgtcttcttcaaattgaagttactttctaaaatggctatataggggagaatagaggcaaaaagggcgatgggatagaaaagaagacgtaagggctccgtgctaagaaagaagaaaaagatgcagttgaaaacaacgtaaaactagagatccaatgtcaattgtttatgtagccaatatcttcgttatgcggtgtgaacagcgacaataaaaaaaaatgtgggtcaaattatggcttttttttcttgatttcctttttctttttattcatgatgtttcgaagaagagatcagcgcgggagagaaagaaagagagagaaaaagagggcctatacggtgaaaaaactacttgcgcagcttcagtaacagcgctacagacaggcgttaacgaataggagaggacgtgtggcgtttcagttatgtcatttatataattttatataaagtataaaaaaagtgaatagaagagagggcagagaaaaccggaccaggaatagacgatcgtctcatttgcatcgggttcatcagtttttggtggcagaggagcttgttgagcttgatgatgtactgtataattcatggacgaaattttcaccccagaaggcagaagtgtatttagagatgtatttgtaaagtttttcccagttaacttctttctttacatcgggcaaagtcaaggcctcgttgatggcatcagaaagatcatcggtgttccaaggatttacaataatagcaccattcaaggattgtgcggcacctgtgaactcactcaggattaaggaacctttcttttcttcttggcaagcaatatattcgtaggaaaccaagttcataccatcacgggtggacgagaccaaacaaacatcgctcacagcatataacgaaatcagctcttcaaatggtatagacttgtgcatgaaatggatggggacgaattccacagtaccgaactgaccgttgattctaccgaccaactcattgaccacagatcttaaatattggtactcttccacatctccacgacttggcactgcaacctgtaccagaacaaccttgcccctccattctggatgctcgttcagaaacacttccatggcgtgcaacttctgaggcacacctttgatgtaatccagcctgtcgacaccaactatgatcttgcagcccttgaaagtttccttcaattgttggattctcttttgtacggattcctttttcaacccatcggtgaacttgtccacgtcgataccgatagggaaggcccctacgttaacgaatctgccctggtattccaccccattaggcaatgtgttcacgttaagcactctttgcacggaagacaagaaatgtcttgcataatcgtatgtgtggaacccgactaaatcacaactcaaaacacccttcaaaatctcttgtctgacaggtaagattctgtaaatttcactcgaagggaatggtgtgtgcaggaaccacccgaccttaacgttttgcagttgcttctcgtgaatcttgactctcaacatttccggaaccaacatcaaatggtaatcatgcacccagattaaatcgttatggttcatagtcttagcaatctcgttggtgaacgtctggtttgcctcgttgtatgccaaccacgcattctcgtcgaaattgatctcaccaggatggtaatggaataacggccatagaatagaattactgaacccgttgtagtgtaagtctgcgatttcatcgctcaggaagatgggtacggcattaaacttttccagcaagtccttcctcacctgatccttctcatcgtcaggaatctctagcccaggccatccgaaccacttgaaagtgtacgtcttcttcaacccttccaacgccgtgaccagccctccggacgacattgcgtactcgtactgtcccgtactgctgtttttagtgattgtcacgggaagcctgttggacaccacaataatgttaccccctgaagacgaggtcagttgcgccttagcgttatccgtagtcatagttctatgtcttaataagtctgtatgtgagtacctagtttgttagcctgctttgttgcttacttagctgcgtgcttgttcaagaagaaactgacagaaactcaattgacaagataagactaccaagttaatcaatctctaccacccggctgtacgccttaatctctctctatatatacatactcacaataatacatgtgtcttagaacctcagtgcagtttgtccatggcgcccccctgagagcccctgccctgacctgcccagcggggtgacccctatcagcctgcggatgagggcccagggggctccctctccctggcgcgctggcactctaggcccgatccctcgtcaatccccttataaacagcgctgacgtgcttggactttgttccttgttcttttgttctttgttctggtgcagatggaacagaacaatcgcaacaagagcacgaagatatggctatcacccctgacaaacagaagaaagaacaacagcatcaaccacagaacggaccgctcgactatgctcacatatgcaagtgtattgcaatgttctttgtcgttgcgggcgtggtgctgatgttcttcgagaccgggttggacccagaacaaaaagagcaaatcaagcgtctccaccagttggacggcattcctcacgcttgatgtgcccagggtgatgtgttccttgatctttttcttttttttttttcaattacggattatgcatatataggtgggtatacgtacgtaaaaaaacaaaaacacacatgtagacatctatatacgtttaaaaaagctttagattcagatctttgggttttacaaaaaaaaaacggacaaaataaaaaaagcctttttcttcagcaaccgtcctcttagattagagattcttcttggctggcgtccttcttcttaccggagcttcttgtgtcgggatcttcttcatcttcgtcggcatcgtctctggctctatcgtaaaattcatcaagaatctttggggagattctattcaacatctccttagggtagattcttagcaaactccatgcctggtccaaactttcgaaaacggttctgtcctcgtaggcgccttgtgtgataaaggtcttttcgaatttttccaaaaattccaaagataacttatcttcgatggataacgcctcttcaccgacaacggccttcatagcagcagcgtccttaccgatggcgtacttggcatacaattggttagaaacgtcaccgtggtcctttctggtcataccttcaccgatggcagatttcatcaatctactcaacgaaggcaagacgttgattggtgggtagatacccttgttatgtaattgacggtcaacgaagatttgaccctcggtaatataaccggtcaaatccggaattggatgcgtaatatcatcgttaggcattgtcaagataggtatttgagtgatggacccgttacgaccctctactctacctgctctttcataaattgtggacaaatctgtatacatgtaaccaggataacctcttctacctggaacttcttctctagcagcggaaacttctctaagagcatcagcatacgatgacatatcggtcaagatggtcaacacatgacgttccgtttggtaagcaaggtattcagcggtggtcaaggccaatcttggagtgataattctttcaatggtagggtcattagccaagttcaaaaataatgaagttctttccaaagacccattttcttcgaaatcctgtttgaaaaatctagcggtttccaagttgacacccatggcagcaaaaacgatggagaaattttcttcatgaccatcatgaacatccttggtaggtctcaccaaaccagcctgtctacaaatttgtgctgcaatttcgttgtgtggtaaacctgatgcggagaaaattgggatcttttgacctctggcaatggagttcattgtgtcaatagcagaaacaccagtagaaatcatttcttctggataaatacgagcatatgggttgataggagaaccgttaatgtccaagtaatcctctgcgaaaactttaggaccgttgtcaatgggtctaccagaaccgtcaaaaattctacccaacatgtcttcagacacaggaattctcaaactctcaccagtgaattccacggtagtcttcttgacatcaataccagatgtaccttcaaacacttgcacaatggctctatctcctctaatttccaaaacttgaccttgtctcacggttccatctggcaatgtcaaattaacaatttcgttgtaacgtgggaacttgaccttttccaaaatgactaatggaccgttcacaccactgaccgtattatagttcaatctaggcttcacattgaaaccttgttcgacggctttcttatttatggcaaacaactccttatcagacaaaaccattcctgcaatatttattttcgcttgatgtactgtctactcttacaatcgcaatcctgtcaacaatggttgtctatctgtattaaaatcatttagtcctttatctcttatccttttctttcaacggggtgaaaaaaaaaaaaaaaaaaacaactaaaaaactgagttggttcttacccgaatgcttattacactggctgctattgtttatgactgactacatgcaactttatacacacggcaggaaaaaaagtgcgcactctagcctaccacgtaccatcggtcatgaggtcctgtgactgttggaggtggtgcggtccgccttgcaggatgtcctctttgtggattattcatgttatccaaaaccatcgagtacaacatcccaaaagtccaatatagcgagacggacctacacttcatcttgttccgtttcaccatattatagaacagcccatccacatcgtactggtccagtagccatgggatatccatgggtgttgaaggtacgagtttcaaatgtctacatatctgtaaaatatttatgataagcttgatcaacctttgtactactgtctgtatgctatcggaaaactcaaacatgggttgttcacagattttatttgtgtagggaagtttaatcataagaatgtctgagaagaagctaatatacttccacatgatgttgatggaatcgtttgttatagcaagaggtaaaatacggaagtttttcaaagatattagtggctgaaaagctatagcgaaaggtatttggaaattatcttgcagcttctggatcacaaaccaattatttagtagattgagcttgtaatctctagccgattcacaaatcttcgatacttgtgccagcttattttttgcatcactaatttccacttgctctcttaatttgtccgtaccagtacccaccttataacatttataattgtcaatttctactttcaattcgctgatgtgattccttttactataaatccgctcatttagctgttctatcctgtgcctaatcaggttattattctttttcattcgtaaaacatctaacttcatgagactattcatcaggggatctttctttttctccatcctcttgatatctaactggtcatagttcatggcctcgtttaatatttgttcgactttcccgttaagttctttattctcatcctttaataaaattaaatctagttttagcttcagtagcagacttgggctcgtattgatacaatgtgcacagtacactacatgcgctctatggtggcaaattgggcaatgcatgtcatactaggattctagtttttaacttttacttccctttttctctactcgttatccttctaatcacttttgtatttggtcctttcccttaattttcagcgaggaaaaaagtgcttattatcattaaaatacaaataaataaatagttttttaactagacgtaaggaaaacaattacacgtattatttaatagtacaaagaaaaaaaaagtcaatacatattcatcattggcattgcttatatattttcggcctttaatttttttcttatcaaaattccactcttgaaatttattatccaatccaccatatcttgatcgttagcggctttaaaagataacctttcatcaaatgtaattagcgcaaaattagtgtcgtcatttttcatcttcgaattattatcaagttcaatacaatcgataattttatccaatttaatgcttttctttaacttcccagtcttgaaagagtataaattgaacgaagtattagtcaattccacattgaacttttgccatttagccctattgaacagtttcttctttttcacttttgtgtaaagaatcccagaacaaacctggtgctctgcatttcttggatcgaacatcctataaaattctttatcttcacgagacagttgctcatccatcgtcaaactgcaagaatgcttgctgctagaaggacccgccttttcgtcaactacaattaaatcatcatcatcctcttcttcatcataatcactacctgtagtgacactttcgttgccactaggactagagaggaatttttcaagggcaattttccaattatgcatcagttccataccaaccttctcattttgccctcgtggaaatttgaatattaaatccttggatggagtataaacagttaatataccatcgagctcgcttatcttaaaattaagtatgtcaaatctcggtatgacacttatagcctctctttcatcccgagttttgtaataggcaaattggtttttcctcaagacacaccaatattgatggtctgttgtccgaggccaccataaatgacgatggtgatgatggtgatgatggtaaccctgcggtgcaccatcagcagctccattgttacctgaactggattgagctgtcggcgttttattttgagacgttgatggcttcttgatgagattcgatgcgatcaaaatttcatgctgacttgacggagcagtcgcacctgctatcattggtcttatgaaatttaccaaggcaaaattagcgtaattatttatggttaattcacctactggctactattgcgtaccacattttggcctgttcgtttaatttcagccacattatagtagagaaaaaaccgttgtgagtgaccgaaagtgaaaaatatggattcgtgtctataaaaccttagaggcatctatttacttttgttctattatctaaatgaatcctatatatatactcccttgtgtcggcatattctaggattgggccccgtgaacaaccatactatttccctttttcttatgagtggaggaaacagttcttgtaacaccgggaggcactgagattgtgggagatgtacttggatcgttattatgcgttacatttgttttactactgctcgagcttggttttcttactgaggcagttcttttaacaccaggcaaaaccggggatgcagattttggaatagaacccgatgacagcaaaggcgacgcagtatagaaacttcttcttttattgttactgctattaccattggaggatgaatcgtttgtgttcggcgtctttcttaatttgaccatcttaataggaagcatatcctgtgcattattgctactcaaagcgtcagcgttgttgctttccacctgggtttgtacattcttcttcaaggtttgtactaccgcgcctttattactaatcttctcatcgtttcttttcaagacgtctttcaaatccatcttttcagcaaaagttgatatcagattttcgttcgtctggtacagatttagccagctttgtagatttaactcatctaaagagtgagtgattatcttgcttaattttgaatccttttctgtttccagagatttcaaatctttcacagagtcattgaatttatttaaattcaattctatatctgaatttgaactagtatctgaaccataatttaaattttgattacttaactctaactccaacaaaccgattttttcatttaatttggaaatttcatcagaatagtggtctctgtaaagattttgtgactccaataatgaattatagttaacttccatattttgcaatttttcagagcaagattgttcaatggcactagaatttttcgccaatttactcaattgatccattttctccttttgttcattgtaacggttactcaattcgctataatctttctctagctcttttagcttcttgttctttctttcaaatatcgagttgagattttcgttctcgttcttcagcagatttaaattttccagtagttttgattctttggattgtgctaattccaatttactcaataaattttgagattgcgtagtcaattgtagatttgtttttgtcagcatatcaatctggtcatgcagtgattcaatgactctcgaagatgaggcattttggctggaggtatttctatcttttgtgggggaactttccaagtttgccataaaaatattatggtgaggtgccaacttgcttgaagaagtctgggtattatcctggtccgacatcttacacaaaagtagtgtcgttgaaccttggcgtgcttgatagacgagctaacgtttggtaaccccttcagactgctgctactcatggcaacaaatcaataaacaaaatgcaatagtagttagtaatgaagctctcgcccgaacaaaagacgaaacgagcgggtaactatttagcctattttattgcgatgacaataatatgtagtagcaatagggaaatagtttcatttgacgtggaaccaaaaatacattctaaatcgtacaactattaaattgatatatgaaagacggatatgagactacactatattacggtttttgatccatcaagatctaccaacgaaaatgacactttcaagcagttgctgctgttccattattttggcactactgattcaataccctctttaaacgaaaaactgtccatcataggagtaatacagggcatttggtcacttacgagttcatgcgtaaacaaggacggcgaagatttagagaaaattattgagctgaacaatgatattattttttgtattaaggtggaatcaagatttttcatcagtctagcaatttcgaatatcagcgacgatcagagtgccatacctttacagtatctcagtgcttacttatggcttagttacaggttcttcaagctactcaatgggtcattcagcggatttaacaaggacttccgcaaactcacggatttgttgaacgaattcgttattccgttctggaatgatatttatttgaatctagaaactgtaacgaatagatcatttactgtaatgtggcctggtttttataaaagggcaaattttcaacattcctcttataatcctggagaaaaaaataatgtcgaagagtcatgggacgctataatcttgcagaatattcttttagataaaaagagttatctaggactaaaggacattttggtttaccacctaccaaagcgcaccaaagcggctaatagggagtctatgggaacaaaaacttatggactagtaaggaactttaccagtgacctgaacacattaccagatatctcaaattggctatatcatttgcactgcacctatggtgaaatatcaagtcatatattaacaggaaatgtccattttaaagaggagctacaagtagaagaagaacaagagcgaagtcgtgatacaaacggaagagacgaagaggaatcacaggagcaacagcgacgggagcaccaagagactacgcaaaacaatacaagcgaactctctctatcggaaagagtgatacacaacgtaacactccccatttcttttgcatacgacgctatacatgaagtgagtaccacgactggtgtttcgggtagcttatccatgataatggactatgtaccgaagccccattggccgttcatttcatcctctaacaaaagtgccgacaaaaataattactcaaatagcaatgataacgcaaattcgaatgccccactgatggcgcaatcagaggctgttggagggacgataggcaactcgagatttggtttcctaatttccccattgaattcagacctgttgccatcatcataccaagccctgaaactgaatttgaactttgaaaactccaaagacaaggaggatttttataattgcctattttggtactttgatgattttttaattgtaattgtctgtgatccggacttcaacaagatttgtgaaagagactatctaaaggacttgagcttccaattgtgtcagagtatggaatgcctaaacaatgagattttaaactctcaaaattgcgataacgtggaatcctttgcttatgtgatcagagataacgtcaccaaagaaatcgactcgtccgttccatttgggtctccaaaatttacttcggatgaaagcatttcaactttacaactagcaattaacggtatagatcagttcattaacgataattcaaattccctatcgcttgctaattggaatccaataactattatgggtggctcaaatgctatcagcaaaaaaaatactacagaaggatttggaaacggggtaaacgataagactcaaaaattcaaaagaaaatatctgaatttcttgaatttaatgagcgcagaaaagttatgggacttacaggttgacgtcttacagttcttgactagtttacagaactcaaagagagacccagattattttcaggaggagaggttattaaaattgaacaatggtgttttatgctatatcaaagaaaacaattcaaacttaattattattattaaaaactggtttcaaaataacggcacgtcaaaggctgcaaaacaaaggaaccgttttagttcagattcctctaagggaagttcattgtttcaaagtttaggtcgtgacgtgactgactggtgggaatccagggaaatttaaaaatgtaacgtttagcatttgatagacatagaataaaaataagtaactataaaaaaaggaaaaaaaaaattgggcaaaatagggatcatattataactatttatatacagattcgaaatatgaagaagagactatgaaaggtgggtgaatatcaatattaaataaaaatcaaacaatgattgaaaaaacggtaaaagatcataaaaagccctccaggtaatatgtcaataagtaaatatactttatcgaaggaaagatcaaaaaaaaaaaaaaaaaaaaatgcaaacgaacatagccaaaggaccacaatattaatctgacaataaatttggaggcagtcaatgtaaatttgtgaatataacgacataattgcattatgctttgctataatattgaaatttttcgaaggagctttcaatctcatggttttcaatttctgttagctctttagaaaagtcaatttcatgtgggtttttgaagtgatctttaccacgtttccaaataaatttgtagcccacatatataccgatgttgataaacaccattaaatacgaaaacaaaaaatcttgtgtgttccataatttgggaaagaaaacggtgtagccctgtattaaaatcattgcggaacatgaaacaaggccgataatagcagtgtatggttgaccccacgaacggaatggcaacttgggtaacgaatcttgttggacgtggtaagcccttctgaaaaataaatagacgatacaaaggacgacaaaattaatcaattgagaggcagtaatcaagttaattaaccaattcaatacgaccgcactattagaattcagttgcaaaaggctcactaaagcccataccaaagatatggccacagagtaaatgggcacaccatgcctattgcatctagtgaagatttttggcgcgtagccatctaatgccataccataaaatgttctggatgagcaataagtgtaagcgttaccagcagaaaaggcggctgtaatcaaagctatattaacaatgtcaggtaatattctaattttcagattattcattgcaatgacataaggtgaagacccggcgccaggccttgcttcattaattgctgctgtcaagtcaggatcatttggcgaacaaacaatcccaacacacagacaactccctaaaaacaaaaatgttaatctcacaaacacctgcttaaacgccttgggtaatacttttcttggtcgtttgacctctcccgctaacatagaaatatactcgccaccagctatggtaaacgatgcctgaatcaagcaagcgagaaacccctggaagtagcccgaagacttccccacatcattgccatcgggaaagtatttcttgaatggactttcaccataattacgaaacccgtaacgatcatgttcaggatttccacccaacatggtaatgaacgtgaatgtaaataggccgagtgcaaggataattttgaaagaagccaaccaaaattccatttcaccgtaatatttgactgcacaaatggaaataagcagatacaaaactacttgaacggcgagcggaataccagctgaataatcatctctccaataatgtataattgtattaacagaaacaatctcgaaagggatctgtacgcattcaagaaaccagaaattccagctagccatgacagccaatgaatcgtcaacgcacttcgttgctaatctcaaaaagggggaacttacagggaaaaagcagaccatttccgctgtagacacagtaatgcaaagtattggaacacaccaaagagcaaatgccaataataaagaggcgggccctccacggtataaagcttttccgatcgccacgaatagcgccgtaccaatgacaccggaaatagcaatcaactggacgtgcctgttttctagtttacgtcgagtttctgtgaaatatagcaggtaagtccttgagtcatcatcaatagaagaccctctatcctcatgttcatccacgtgaacatcgcccgcttcgggtatcgtgtttatgtgacccactgacccagaaggttccaaccatccctcactaggttcgatactctttattcgagtggttattgtcttgtatttattcttatcgtactcaaaatcaccgtcattttcgtagtcgatggtcatacgttcctttgtcatgcttggcaaaagttatggaagcaaaatgtaagtgcagcttaggggggacaaggctgaaggaaaactattgtttttaattaccacctattagtatcttaaagcaaaggagctaaccgagataatatcaatacgaagtatggtgaactaacactacccttactcctgaattacataaattaaagcaggcaacatgtcgagatccatttaccattgaagagttccaaaaaaagggttctttttttatacatgtagttttacggtgcggcgccgacaccccgctcgatcgatgacgctgacttgtggtactcaggacgtatggatagttatttgttgccgcagtatatagtatacaatgcagaattcacagaggcagggaaaaggctctgccacagacattatgtagcgtggaaacactagtcttgactctgacatgaacttctggaacatcttcctcgaggtcttcgtgccttggcaattcgttagagggttcaagcgctttagtagatttgagatcaaacataggcttattgatagaatctaaatggtccggtttggcggtttcgctgagtccgtgaatatcttgtacgctttgccaaccagtttctagattggataggaatccctgttcttcttcgttttcaatgtcttggtcaagatcaatttgattatctagcttttgattggtagtcgctgaataatgtcgattatgggctaaagttttagtgtcatctgtaactatagacctcggaatagtcatgcttgcagcagttaccgccgaagtgtaatttgacaacataaggtatatgaaactctccaaagaccattcataccaaactttttgttctgtatcggagtgtatccgagacatcagcacagaaagttcggagtcatctataaaggatattggttgcttcaaaggaaagataattggagaccacgaggtcatatttggtgtatggtcacatttcttgattagattttcttctcgtctggtattcatcaacgtttcttcgctaaattttaaacggactgtgctgtcattgggcaaagttgacaagaatatattgttatataagtttgccgagaagaatccgataaagccatggatttcgccgcggtgctttatcttgaactcatttaatgaactttgagaaaattcaactgtaaaatcatcttcgtcttggacagtatctttttgggccatgggatgctcgaaccgccacacttcatttacccttgaggataatatacagtatggcactctatggactatccagggcgcctccaaagagcgatttgtttgtgagagtttttggtagaataatggtgacgaaatgggtgctatgtatgaagagtatgacctcggtatgaaaattgtgtcattgtgggaatgatatttttcaatagaccagagacattctggtgataattcattgcaaccgaacgaacccagcagttcacttatgcacagatctatctgaatacgcttttccgacggctcgttgatttgccatttggtcatatcctccttgattaatttcactctattatcccaacagtcgaaatttcttttttgcaagtacagatatgcctgtggatttttttcaatggcaattatagaaaccttactatccataaacaacattgatattatcttaaaagttcgatccactaaaggtcctcttcccgcaccggctactaggatcaccaacggtctcttggcactcgctcgaggagcaagatcttgaagcgcctctaatatggcagattcgtaaagatcgtacttcaccaaatctttttcaaaagtcaaatatgtggaatttaataaattatctgaatgaggtttcagaggcggcattatccgagagtcctcttggagcaaaaattggtgattactattggaatttaatactttgtcgccctttttcaataagtagtttatatattccaaataggcagattctccgcccttaacattattggcatatttctccatcccatgcaatatcacgcataattcattacccaaaatttgtgaatctccattaaccttttggaactttaaaatcaaattctggttaaacttgtgtaaaacgggataatcgtactgattactggcaaagatggatgaagataccaaaagacacgagacgggttcggctaaccatctattcagcacatacgaaggagtcctggttcttggcaaagccaaagagatagtcaaagagggatgatattcgcattgtttccgcacggtattccacagttcccaagtggccaatggatcgctgtcttcgtaaagtggcagagaaatggatatggttaacgcaggcgcagcaaagacgatgcgattttgcaggagcctgtaaatcatctgtccatacaattgcaggttggacaggtcccgtggaggcgccaatattagcttattgattccaacaaacctcgcgtacttacattcgtttagaaggacctttaagccaagatctcttacatttggatcgcgactctccagctccagccaagaggataacagccctatgtaagacggcgtatcgtcattgtctagcttcttgacgttgaacgggggtatacagatatcctgcaactgcggttcaggaatttgaagcggtttccagttctgtatggattgtctttggaaatctttgaaaacttgcccaactatttccttatatcttggcgttgttataggaagcaaaacgtaatcatagttactaggcagttctggtgaatgactagagacattttctaggaaacgtgactttttgctgtgctgtttatgattaaagcctggtttgacaccaacaaatacgttgctatgcatatgcaaactgaaccctttgtatatataaaaattatatgtataaaagaagaggaacgtccgcacaattccacacacacacacacacacacgctttcacacacgcaatttgaaatagctcctatagggcttgggaataggatcacaagtcactcgaaatataccattttttctatcacacatacacattgtataaagccatttgtttcaaaaaaatataaaaacactgcgcagcgtgctgtttcgggttccatttgtgattgtttatttttcttttggtttagctcagtgcaaaacgagggctcgaagaattttcagataaaacagtactcgagccctgagatctgttttagggtctaaaaggcgggttataaaaatatgtcaggtgatttttttttctcgtggtatgagataaataaagaatggagcttttatgcatgaaaggacagcggatggcagtagagcagacatcagtagcattcattacaactctgtcgtaagttcttggaactgctggccgcgttggatacaactagattgacacgcacttactctcgtcttacagtactatgtaccatcactatcacgccttccaaggcagaaagcttactgaccaagaaagagcacgcgtgttggagtttcaagattccattcactattctccgcggtactcagacgataactatgagtacaggcatgtgatgttacctaaggccatgctaaaagttatcccatctgattacttcaattcggaagtggggaccctgcgtatattaacagaagacgaatggagaggcctcggcatcacacagtctttggggtgggaacattatgaatgccatgcgccagaaccacacattttgctattcaaaaggccgctgaactacgaggccgagctgagggcagcgaccgctgctgctcaacagcaacagcaacagcagcaacagcagcaacaacaacaacagcaacatcaaacacaatcgatttcgaacgatatgcaagttccaccccaaatctcctagctttgatatactctaattactgaaattgaattccttttcaaggctccataactatatggagcatactatgtacttatcataataaagaataaacaaacaagcaaacaaaaaaaaaaaaaactatggatcatagttttcaccaacaagcattagaatacaaataaaatttatatagtgaatatccttcaaataaatttcttctttcccttataaatcaaatagatggaacgcacgctccaaaactagtcaactagaaaaaaatacccgccgacggacaattttgaagagagatgattaatgaagacaaagtgaggctggacaacaagaacgacatacaccgcgtaaaggcccacaagactgcatggaatcacacgtcaaatatcttgacgaattgatattggcaataaaagacctgaactcgggggtggattcaaaggtgcagattaaaaaagtgcccacggatccatcttcttctcaggagtacgccaagagtttaaagatcctgaacaccctcataagaaacctaaaagatcaaagaaggaacaatatcatgaaaaatgatactatattttcgaaaacagtttccgcccttgccttattgttggagtacaaccccttcttgcttgttatgaaggattccaacgggaactttgagatacaaaggctgatagatgatttcctcaacatatccgttctgaactatgataattaccacagaatatggtttatgaggcgaaaattaggcagctggtgcaaagcatgtgtcgaattttacggaaaacctgctaagtttcagcttactgcacattttgagaacaccatgaatctttacgaacaggccttgactgaagtcttgttgggcaagactgagcttctcaaattttatgacaccttgaagggtctatacattcttttatactggttcacttcggagtatagtacttttgggaactctatagcattcttagattcttctttggggttcacgaaatttgactttaacttccaacgattaatcaggattgttctttacgtctttgattcctgcgaactagcagcactagaatatgccgaaatccaactcaaatatatttctctagttgtggactatgtttgcaatagaacaatttccacagccctggatgccccagcgttagtttgttgtgaacaattaaagtttgtattgactactatgcatcattttttggataacaagtatgggctcttggataatgaccccactatggccaaaggaattcttcgactatattctctttgcatttctaacgatttctcaaaatgctttgtagaccacttcccaattgaccagtgggcagatttttcacaaagtgaacattttccgttcacgcagttgactaataaagctctctcgattgtatattttgatttgaaaagaaggtccctacctgttgaagctttaaagtacgataataagttcaacatctgggtataccaatcggagccggactcgagcttgaaaaatgtcacttctccctttgatgatcgatataagcagctggaaaagctaaggttgctagtactaaagaagtttaacaagacagaaagaggaactttgctcaaataccgcgtgaaccagctaagtcctggattttttcaaagagctggaaacgatttcaagctaattttaaatgaagcatctgtatccattcaaacttgtttcaagacaaacaatataacaaggctaacatcatggactgtaattctcggacgtctagcctgtctagaatcagagaagttttccggcactctgccaaattccacaaaggatatggataattggtatgtttgtcatttatgcgatattgagaaaactggcaaccctttcgtgcgaataaatccaaatagaccagaggctgcgggtaaatcagaaatcttcaggatacttcattcaaactttctatctcacccaaatatagatgaatttagcgaatctttgttaagtggcatcttattttctctacataggatattttcacactttcaacctccaaaacttacagatggaaacggtcaaatcaataagagctttaaactggtacaaaagtgctttatgaattctaacagatacctacgtttattaagtactagaattatacctttattcaatatatcagactctcataattccgaagatgaacacactgccacgctgataaagtttctacaatctcaaaaattgccagtggtgaaagaaaatttagtcattgcttggacacaattaacattgacgacttctaatgatgtatttgatacactacttttgaaactgattgatattttcaattctgatgattatagtttacgaataatgatgactttgcaaattaaaaatatggccaaaattttaaagaaaacaccatatcaattactatcgcctattttacctgtattactaagacagttgggaaaaaacctcgtggaaagaaaagttggctttcaaaatttaatagaattattgggatattcttcaaaaacaattctcgatattttccagagatatatcatcccttatgcaattattcaatataagagcgatgtgctaagtgaaattgctaagattatgtgtgatggcgatacaagtttaattaaccaaatgaaggttaatttactgaaaaaaaacagtaggcaaatatttgccgtagctttggtaaaacacggattattttctttggatatcttggaaaccctttttttaaatagggctccaacttttgacaaaggatatataactgcataccttcccgattataaaactttagctgaaataacgaagctctacaaaaacagcgttactaaagatgcaagtgacagcgagaatgctaatatgattttatgctctttgcgatttttaatcaccaattttgaaaaagacaaaaggcatggttcgaagtacaaaaatatcaataactggacggatgatcaggaacaagcgttccaaaagaaactacaggataatatcttaggtattttccaagttttttcgagtgacatacatgatgttgaaggccgcaccacttactacgaaaagttaagggttatcaatggcatttcttttcttatcatatatgcccccaaaaaatcaataatttccgcattagcccagattagtatttgtttgcaaacaggacttgggcttaaggaagttcgatacgaggcctttagatgttggcatctgttagttcgccatctaaatgatgaagaactctctactgttatagatagcttaattgcattcatacttcaaaagtggtctgagttcaacggaaaacttcgaaatatagtgtacagtatactggataccttaatcaaagagaaatcggacctgattttgaaattaaaaccttacactactttggctttagtaggcaagcctgaattaggtattttagctcgtgatggccaatttgcaagaatggtgaataaaataagaagtaccacggaccttatacccatatttgctaataacttgaaaagtagtaacaagtatgtcataaaccaaaatttagacgatatagaggtatatcttcggagaaagcagacagaaagatcgattgattttacaccaaagaaggttgggcaaacttctgatataacattagttttgggtgctttattagacacttctcataagtttagaaatttagacaaggacctatgcgagaagtgcgccaaatgtatcagtatgattggtgttttagacgttacaaagcatgagtttaaaagaacaacatattcagaaaacgaagtttatgatttgaatgatagtgttcaaactattaagttcttgatatgggtcataaatgatatcctcgttcctgcgttttggcaaagtgagaatcccagcaagcaattgtttgttgcccttgtcatacaggaatcattaaaatattgcgggctaagttcagagtcatgggatatgaaccataaagaattatatccaaatgaagccaaactatgggaaaagtttaactctgtctccaagacaaccatctatccgcttttatcttccttgtatcttgcgcaatcatggaaagaatatgtcccgctaaaatatccttctaataacttcaaggaaggatacaaaatttgggtgaaaaggtttacattggatttattgaaaacaggtacaacagaaaatcatccattacacgtgttttcctctttgattagggaagatgatggctcactatcaaattttttgctaccttatatttctctggacattattatcaaggcagaaaaaggaactccatacgctgatattttaaacgggattattattgaatttgacagcattttcacgtgcaatctggaaggaatgaataacttgcaagtggattcgttaagaatgtgctatgaatccatcttcagagttttcgaatattgcaaaaaatgggcaactgagtttaaacaaaattacagtaaactacacggcacttttatcattaaagatacgaaaacaactaacatgcttttgagaatagatgagtttttgcgaacaaccccttcagatttgctagctcaacgctccttagagacggattcttttgaaaggtctgctctataccttgaacagtgctatcgacagaatcctcacgataagaaccaaaatggacaactactgaaaaatttacaaatcacatacgaagaaataggagacattgactcactcgatggtgtactgagaacctttgctacaggaaacttggtttctaaaattgaagaattgcaatattctgaaaactggaaactcgcacaagactgctttaatgtcctcggcaaattttcagatgaccccaaaactacaaccaggatgctaaagtctatgtatgaccaccaattgtattctcaaataatatcgaactcttcgttccattcttcagacggaaaaatttctttgtctccagatgtgaaggaatggtacagcataggtcttgaagctgcaaatctagaaggcaatgttcaaactttgaaaaattgggtagaacaaatagagagtttaagaaatattgacgatagagaagtacttttgcagtacaatattgcgaaagctttaattgccatctcaaacgaggatccattaaggactcaaaaatacatccacaattcctttaggcttatcggaacaaattttataacgtcatctaaagagacgacgctgctaaagaaacagaatttattgatgaaattacacagtttatatgacctcagttttttatcttctgcgaaagataagtttgaatacaaaagtaacactaccatactcgattatcgaatggaacgtattggggctgacttcgtgccaaatcattacatattgtcaatgagaaagtcatttgaccaattgaaaatgaatgaacaagcagacgctgacttaggaaaaacattcttcactttagcccaattggcgagaaacaacgctaggctagatatagcctccgaatcattaatgcattgtttggaaaggcggttgcctcaggcagagttggagtttgctgaaatactatggaagcaaggtgagaatgatagagccttaaagatagtgcaagaaatacatgaaaagtatcaagaaaattcctcggttaatgctcgcgatcgtgccgccgtgctattaaagtttactgaatggttagacctttcgaacaattcagcgtccgaacaaattattaaacaatatcaggatatttttcagattgattctaaatgggataaaccatattactctattggcttatactatagtagactacttgagcgcaaaaaagcagagggttatattactaatggtcgttttgagtacagggcaatatcttactttttattggcatttgaaaagaacactgctaaagtaagagaaaatttgcccaaagttatcacgttttggctagatattgcggccgcatcaatttctgaagctcctggaaacagaaaggaaatgctgagtaaggctacggaagatatatgtagtcatgttgaagaagcgctgcagcattgtcccacttatatttggtactttgttttgactcagttgttatctaggttattacattctcatcaatcatcggcccagataataatgcacatactgctaagtttggctgttgaatacccctctcatattttatggtatatcacagcccttgtaaattccaattcttcaaaaagagttcttcgtggtaagcatattttagaaaagtatagacaacattcgcaaaatcctcatgatctagtttctagtgcattggatttaacgaaagcattaactcgtgtctgtttgcaagatgtcaaaagcattacaagtagatcaggcaaatctttagaaaaagacttcaaatttgacatgaacgtggccccatctgcaatggttgttccagtaagaaaaaatttagacatcatttcaccactagagtctaactcaatgaggggctatcaaccatttaggccggttgtttctataattagattcggatcatcttataaagtgttttcttcattaaagaagccaaaacaattgaacataataggttcagatggcaacatttatgggatcatgtgtaagaaggaagatgtccgacaagataaccaatatatgcagttcgccacaacaatggattttcttctgagtaaggacatagcttcaagaaaaagaagcctgggcataaatatttactccgtactatctcttcgagaagactgtgggatattggaaatggtaccgaatgttgtaactttaagatctattctttctacaaagtacgaaagtctgaaaattaagtatagcctgaaaagtctacatgataggtggcagcacaccgcagtagatggaaaactcgagttttacatggaacaggtagataaatttcctccaatcttgtaccaatggtttttagaaaactttcctgatccaatcaattggttcaacgccaggaatacgtatgccagatcttacgccgtcatggcaatggttggccatatattaggtctaggtgataggcactgtgaaaacatattactagatatacagacgggtaaagttcttcatgtagacttcgactgtttatttgagaaaggcaaaaggttacctgtcccagaaattgttcccttcagactaacaccaaatttattggatgcgttgggcataattgggacagaaggaacatttaagaagtctagtgaagtcacgttggctttaatgagaaaaaatgaagtagcgttgatgaatgtgatcgaaacaattatgtacgatagaaacatggaccactcaattcaaaaagcgctaaaggtcttaagaaacaaaatccgcggtatagatccgcaggatggcctggtattgagtgttgctggccaaacagaaacattgatccaagaagcaacatcagaagacaatctaagcaagatgtatattggttggcttccattttggtaacgactttccaccattttcggcaacagacgaacttcctcttgatctaaccatcactgcaggtgcttttctccggcggagttaatagatacttatccccgcttcatgtcatactatctctcttaacagggatgttgacaccatataagttaacataacatatacgtacgtaataatattaaggactatctcgcatttcaaaagagaaacaacctaatcaagccttattataagagcaaattattcaaaaaaagtctacggagaaaattattatggtggttttagacaagaagttattggaaagattgacttctcgtaaggttcccttagaagagctcgaagatatggaaaaacgatgctttttgtctacttttacatatcaagatgcctttgatttggggacttacataagaaatgcagttaaagaaaatttccccgaaaaaccagttgcaattgatatctccttaccaaatgggcattgcttgtttcgcacagtgacctacggtggcagtgcattggacaatgatttttggatccagagaaagaagaagacagcgcttcgatttggtcattcaagtttctatatgggctgcaagaaaagtgacaaaacaccggaggaaaagttttttgtggactcaaaagaatacgctttccatggaggtgctgtcctaatacaatcggagagaagtgactacccctatgcctgcttaactataagtggattgaagcaggaagaagaccatttaatggcagtcagctctttaattgcatttgctaatgaaagtctagaagaagatttgaatttggattgagaatgtaggtagaagtaaaatagaggcttgaacaccatagaatattttttacccgttactagtataactgttatttagtcgtaagcttttcatatatatattgattgttttgcccttgaaaaaatacacagcaccaatgcagtcctgtttgttttagtgatctcttagcaatgtattttcaaggttgaaaatttaaacgatcactattttgattgcgtaagaaatgcggaagtaaaccatttattctccacttccacttcaattttcttcttgcttccaaaaaccaattcattgatttagagcccattgcatctttattaaaatgatgtttgattgacttatcattttctagcaattgcaactgcaatcgttctattagttccttagagaagctgtcctttttttttgatatttcctttttaaggtcgatcttgttatcttctatgtgcctatttattttttttggaacatctgtcgataaatgaaacggttctgctgaattctctagatcactaaaagtaccgctgcttagatttgattcatccatagatgattcgaactcgcagttctcaaagattttagcggcttcttcatatctaactgtgcattgctcacatacaatttctttatagtatcctgaatttaaaagtctcgagctaatttcatatagggccttttcgcagatgacacatttcctcagttgggaatgaacatttaattccgatagataaagatcatcgtaacttttattggaagatggaatattaaccaagttaaccaccatattttcaatggaatttggtatggaaatatcacttatttcaatttcctctttgataaaatctaaggggttgttactttcgtccctattttcttcagtattccttaatatatggggtatcagtgttagtgaattcggttcaaagctatttctattggtttccttattaatttcagaatatgaattttttactctcagcgggatatgattatctcttcttttacttagttttgatttcaaatctgaaatagataccattttttttgttgatttactttgggtatacggtatgtagtcttcaaccaggactagcggtggtatatcctgagaagtattttctgttagctcgtagttttttgtatctaaactcggcccataactgacgtacctattacgtttgttgttatgcactcgcagttcatttacaggattcaacctgggccgttttttattgttgttgtattcgttgtttccactgtcatcttcattagtttcgatattgcatggaggcgcaattggcaaagacgtaaagctcttgtcatcaattagatctaatttggaaacagattggtacaatttggatggaattttaggcttggcacctatacattgtgagcgacgctttcttacattcaataactgttggttctgattttcactttgactattgccttggtatggagaatttctctgcaatggttttgcctgcttcgaaggagtgctgttactatcgaagataaattccttcttttcaaattgccattgtaacatggagttattctctatatcctggacgactggaggagtcaagggcctggaaagtacggatcctgtagaaatatcactggcaattatactgagtttattgttggtgttgctattcatatttgagctggtattggacgaaagcaaggataatgagtttgtgtctactgactccaacaccctaggctggatttgatctttctccatcctttaattttaaccttttaattagtggttggatcaagttttcgagactattccaatctgtgacttgttggataaatagtttttgactcgtttagtataatccttttttctaaaagtgcttagagttctctaagatgttcttgtttacaatgtgagcgatttaggaaatttcctaaaaatggccgaggcggcgctagcattctacgaaaggtgagataacgcttcgttatcgaaaaatgtcaggggacaggggttatataagaacgaaaattgtcatcctgcattttttctttaaaacagctatacaaaaagtgataccgacatacaatgaagtatctaaacttagttttcgtgcttcagcttcttattagcatcaaatacgcctcattcggccgagccttttctctttttgaagatgataccacctttgccaatttggataaacagctaaagcttccacagaatacacagcaaacccttaaattggaccgtttgaatcacgatgatccgctgtttacaacttttatttcttctgtggacacagattacagtttgagacttagaacagtagatccttctaaactaggaattgacaccgtaaaacaatggtcgggttacatggactataaggattccaaacactttttttactggttttttgaaagtaggaacgatcctgctaacgacccaattattctttggttaaatggtggacctggttgttcctcgtttactgggttgctatttgaactaggcccctcatcaattggcgccgatatgaaaccaatccacaatccctattcttggaataataacgcttcaatgatcttcttagaacagccactcggagtcggcttttcctatggtgatgaaaaagtctcctctacaaaattagcaggcaaagatgcgtacattttcctggaattgttttttgaagcttttcctcatttacgctccaacgatttccacattgcaggcgaatcctatgcaggacattatatccctcaaattgcacatgagatcgttgtcaagaaccctgaaagaacgttcaatttaacttcagttatgattggtaatggtatcacagaccctttgattcaagcagattattatgaaccaatggcatgcgggaaagggggctatcaccctgttctctcatcagaagaatgtgagaaaatgagtaaagctgcaggtcgttgtcgtaggttgaacaagttatgttatgcttctaaatcaagtttaccatgcatagtcgccactgcttactgtgactctgcacttttggaaccgtacattaacacaggactcaacgtctatgacattagagggccctgtgaagataatagtactgatggtatgtgttatacaggtctccgctatgtcgaccagtatatgaattttcctgaagttcaagaaacgctagggtccgacgtgcataattattctggctgtgataatgacgtgttcaccggatttttgtttacgggcgatggaagtaaaccatttcaacaatatattgctgaattattaaatcacaacattccggtattaatatatgcgggtgataaggattatatttgtaattggctgggaaaccatgcttggtccaatgagttggaatggatcaataaacgtaggtatcagagaaggatgttaagaccatgggtcagtaaagaaacaggtgaagagttgggacaagtcaagaactatggccctttcacctttttgagaatatacgatgccggtcatatggtgccctatgatcaaccggaggcaagtttggaaatggtcaacagttggatttccggtaatcgtgctttttcggatctttccaccttggaaaatgctagttagtagtgctctaaaaatgtttcactcttaaccttgcaatcattatactttacacaaatctctacgtttcatttaatttaaaatctacaatccaacaaatataaaacaaaatataattataaggaaaaacgtatataatcactgcaatactctaatttaaaattaggagcacgacattcttgccagtatcattgttgctaatctttttctctcataaattgccacttgatgttcaccctctccttttaacttttctatatgttcctgatcaaaaatatccagaggcttcacaactgacaagcctctcttttttaaaagttcgaccatttcatcattaaattcctctaggtaattaaactcactgtgtgtaacaagcatcccaatcaattcaaaagagacagcaaccgcttcagatgattgttctagggttgataacctcctgaattcctttctagtcagcgtatagaacctgaatacacaaatagggttgactttgagcaaatacctcatcaatagagcaaaacggaatttacatggttcgtctgacataacacagctaaacaaaagtgctccttggtataagactatattagatttatctgagtctgaacttagccagttgatcaaagtaagtggcacttttagtgtattatttaaaggtaccagttcatcttcgaagccgacttcaagtaacaaggtagaaagttgttcaggacttaagaccaaatggagtaagaaaaggtaacaaagataatcggaggattttgggttggactttctttcgtaatatgtattcttgaaaagggcctgtagacaatctaatgcggctccttttacgacaggaatggataaaccgtttgcaatgaaacctaaaataatatgaggaaaattatcttcgttccatatgcatccattgtatgactctaacttagccaaaagcgtagcagcaaaatttctagattccattaattttttggctagcgatttgccatcgaatccaagttgaagatggaccgtgtacagtcgcttcaaacaatttaccatgaacaggagaccaccttcaaagagtaaaggatgaggggattcaacacatattgtagcaagccaaaatagctctttcattaattctgaagaaggatctaacccttcgacaattttgctgtaagtaaagacatgagctataatgatgaacatttgttcatcatccacaactggctctgcgaagaccttcatggtttcaactaaaagttctttacaaaggaaaagggacgtgtgcgacttactcattatacctagaatcatcatagctctcgcagagaagaacgaccgatggccaaaaatcgcatccatcaaatatttcttatattttgcctcccattgtgcaccctctgaaatagaaccatattccatcaatagcataatgtttttagtgaagagatctaatgttccgaatttactggagaaggaggaagcggcaaaatttggtaaaactctacctttttcttggctaaaaccggagataaagttcaacttttgacgtgcgaatgttgcacagacgatatccaaatttttcctattcctttcaggtaaggactcattgttggttaaagaatgacaaacattcatcaacaactcgtacaatgagactcttatttccgaaggaccgacatcaattaacagagacacagcgaaaagaatctccggtaaatacatctgggaaagtaagggtgattcaaagaaaattgacacactaatttttgataaaatagtaagctcagaccaactgtgtgcggaagcctcaactgctagagaaggtagaaaagatttgatcatatttattagcttctctattacctgacaagcaatctctgtcgttggaaaactggttagtattgacacagctttcatccagtctctgttttctgaatctctatccagcgcatgacttactatttcttcaactatcacgttcgtgagacgaccatccaatgccagtaaaaaccaaatctgttgaaggtaagctgtcgtgaaatttggctctttgaccgtcaacctgattaagctatagattatacgtgaaatcgcctctggtccctcttcgtcatttgccaaatatacatgttcatataagtttggtacccagtatgacaatgaacagacaaccgtaggaatatgttcttgaggaatcacgtcgttttcaaggccatccagcatatatttccatatatatggagttagttccgttgaagattctgaaaaagccttgaaaattagggccaagaacgtggtggtatcatcgggtacatatgtctctggggatttgtgaagccttgtcccaaaatctaaattaaatgcttcttgcgttgccacgagaaggttgtatgatatgtttttgacgagatcatcctcattgaataaacctacaaggatcaccaatgacaaatgtgatataatttcaccaacttctttaacattgcagtaagaagcattaactgctgaagaggatgttgaaaatgaaatatcgttcgaaaaatccgtaccaaagtcttcttccatctttaactgggcataataaaacattttcacaatttctaggtacttcggactgcaaaataccaacttttcttcattatcaagacttaacgtaaattccgaggaaacgcctgtggtgttagagacatcgactgaaattaaatttgatatcttgtaaacattgttgaatttgatgctgaatgtcctgtttgatacggtaaccttgtacaactgcggaatctcatgtaaaacttggaagtatttgtttcctatcttcaaggacacgggacaaaacttctttttttccttgtcataaagggtaatatcatgcaaagtaactcttacatctttcaaaacttccaaactcctaccactcaatcctaaggactttatcaaactttggtcagtattgctgttgatgaaacaacggggaattgtagtgaccaagtacggattttctacagtatatgatgaggcccattggtccataaatgatttgttgacgttgaagtaataacatcccatacaattacttgatgcttgctctggtatcaaactgaaaaatagagtagtcaatttttggaaattagccttacccccataaaaggtggtacaatcgataactacataatgtttagagcaccacattcttgcatatatctgcagaactttatagaccagtgagtccattacaaaattattgtactcgcaattggtaaaagttacgacaatgatttgtatgccatccaatgtcattgcttcatgtacaaatggcgcattatcctcttcttcttctttcatgtccacttttttgaaggcatagcgactcatgaattcatacaatgaaggatatttttcccgattctcgactacaaaaggaggaatttcattttttatttccatgctaggttgtcccaatacaccaagaattttgtcgttgagcataacagtatttttcaaaaagctgaactcccctggtaatttggattcattaataatttcttttcttatggtaaactcattgaggtaaaagaatttatgcaaaaatgagtagtcaaagcttattggtgtcggatcttctcttacattgacggtgaaattgttagtcggtatcttgcacaattcagacaaaaaattgaatattttatcactacaggttttcaaaaactcttcttttgaaactaagatatctttcttgaatatattttccctgccattagctaaactttgaataactttagctagtgtaataaagggctttctgtcatgggcgtgcgtaacaataatgatattttccgaatcaggactaactaaagcaggcccgataaacctcaagaaaacgaatgacccaacggcaatatatgcgtattctggaaaatttacactagcagcattgtaaattgttttacagatatcaactaattctattgggaaatcatcaatagaacttgtaattgcgtcaattaatcttgtcatgtacttctcaaataagtctaacatcttttcggagttttcggatcctggtttcatcttatcaatttcaaaagactccttgttatccactatcccttgcaaaacgggtctcaaagtttttatcaaatatttgttacctctagatctagtgtaaagtgacaaagcccttgttgcacaactatttcttctgagaatatcgtctgatcttgcggcccgtttgatttcttgtttaaggagctcagtaacaaggatatgagacgcatttctagtgtcaaaggcgtttaagaatccaccagcatataaatcaacatcagcaggagaacacgctaaacttccgaaaaatgctaatattgggttcttgattatatatttcaggaagtcgtctatagctagcattttatccatttcatgtttctcagggttaactggatagttggttactatgtcgatgaaaactcttaaaaaggcgattctgatatctttatttggagaataacccattggtaaagtgaattttaaagaaacgttgacattggcattagataagttcgttagcgctattattacattttcattaagtatactgatcttatgccttaatgaaactggaaactgattcaggtccgcgcttttctccagaccttttaacaaaatagtaaagtgattgccaaatgatactgtagaagatctgttccaatcttcttttgagcttgaaggcggtatttctaaaggaacattatgtgttaggtaagccaatgcttttgcagattcaatagaagtgtcgatatacaaaaaatcttcgtcccttttctgcaaatccatttcccttaatggtcttgacaggttttcaaaatcataatccttattaatagatagtttgaaccaaccaataactaacttcaaccatttattctttaaatggaaatgatttgaaatgcccaggttcttttcagagtgctcaaatgctctaaacattttcgacatttggataattcccttataatatttggaggacttgatggaaattttctccactatttcgatcaacttatcgaccgcatcaagcaagtccgtcgaaaagagtagcattatcttttcatcatcatccctctttagtatagttcttattataattattatctgctctagtaaaacaaacgatgaatcctcatgtgactttgaaagatcaattgacatcagttcatctattttcagtcctaggttgttaaacaataagttaaaagatagaggatgcaactcaatacttaatatatctctcgaattttctcttgttaatagatttggattattcaaccattgacattgttttgaaataaagaaattcatttttttcgttaactcgagtttaagacttttgtgcacctcataagcgggatttcgtgactcaaatgataagctgtctccttcattatctggagcgctcttgcttttttccaactcttgcatatcagacagaatacctgacatagaagctagaatgcctgccaagcttctaaaatctactagttcctcttgcgtaactgatttcgaacagctgaagtaaaaccacttcttgtaaatcacgtccattgaatccaaaaggattgagtcggatcctttgatataagttaaaatattatttcttagacgccgttgcaaagccactgatcctgaggcagtgaaattgtcctgggccatagcatctatgaaatcaatattgtaaatggaatattgatccaaagcgcctacgtatttttgataaaatctcaaggatcgtagaaattcacaacatgaaatttttattaagcgtggcgtatttccacgactgcagtataatgaaatgaaaattccacttcctacagcaccaactaataatggcagcgtcaacctctccgtcgtaattattgcctggactaggttgtgtttttctgctaaatttgataaataagaacggactcgttgaaatttaacaataatgtctagtagcatctctctcttcgcattttctaacttcaaatcaaacaatgatgaagcaaacaaagtaacggcatatgtacataacaaataatggtcattcagtactcttgggtcaagatcattatcaatgtcttcaaaagtagctatataacttaatgggatttcaataaaagcccgcgctgtaacttgtagtctttgattagaatccaatatagagacaaaaagtggttttataatatccgtaaaagtcttcgggaattctgtattagcatctgggcgtataaaccagttggtcattcttttgaaaatgctgaaaatgttcatcataatctttcttgcttcatcattgtcactcagtattactcttgaataagaaggctgtttcaattgtttatcatcagcaattttttttgttttgtttggttttggagatttgatgtttttcaaaatagttggggttgccgtaatcgaatgattagaagaaaatcctgcacttgacgagaggactgagagcggagaaggcaagtcactttgttgcaattgcggcggagaagaatatggactttgtcgtgatctttcagagtcgttcggtgaagcgtatctcttagtagtaggaaccccagataatctatgggctaacaagtttgcattattattttgttgtgcctccaacggattagtcaaaatgttagacaagctcaaatcagaagcacttgatctgttcgataaggttggtaagattgattgaatatcccaggtgcgcgtattggtgatattgcttcctgagttaattgataagggtgattgggaaagtgaagagactaacgaggcatccgatgagttatgaataatttcggttggctcagtgtaaacgcttgtggcagcatcaaaactgacatgatcatcattagaaagtgttcgcgcagcgtcaaattgatctaaaatatgcccatccaatatagaagcaataatcttggttacattatcgtcaaaataaggcgttgctttcaacaaaatatcagcaattatgcagaaaagtctctttaacacagaggaggttttttctgcaatatcctcatgaagttttttggtgcttactaggtgaaaaaataccctaaatccttcagtgtataacgatattttgggaaggtctatgtgattgagttctttttccagttgtaaatgtcttaaaaataaatcagaatccagctgtaaaccgcttgcaaaaaactctaattgtaaacgcctatgtgtaaggggattcctttcaacacaatgagaaataaaagtatttgcagtggcagaattccaattggtgccgacctctaaattttgacccaacaagttgtagaatctcttcgaaaaaataacagaagcaatatttgaatcgatttgggatatagaagacgtcattgtcattaagaatagaatggacctgatagagtcaatcaaggaaacatctgaaacgaactgtcccccattcaaatttctaatcaaatatgtcaaaaatttaacgttacgtttcctgccttgctgtaaagtaagtttttttaagccatgggtgaggtgcctgatacttgggtttttggatgctgagccccaacttgaagtattagagtccttcggattaatattcattatcggttccgaaatttttctatacgaatttgagttcatctcatcatatacttcactgtctaataaggtcagaaccaccaaaaaccttaatatggcagtatgggaggatagttctgatccggtatagttggaatacagctccataatattttccatatagtttaaagaagactgatcgttctgagactgagaattattaactcctgcatgcatatttgtatttgtcatcgatgcattagaatgctgagaagtatcccaaagaaacaaggagttactatcatctagattgagtgattttctactcgagttaaaggatgaaatgtcatctaaggaaaatatgcgttgtggaatattattaagattagcgctgttgttattgttattattgttgttagtattcatagtagagggcgtatctgcatctgttttggtagttgcagccgtagtcgatgtggaagtattcgcctgtcctagtgttgaagtgattggagataacggataccctaggatgttcgtgtttaagggtgaactcaatgatgccataggggaagtaggcgatgcatcattcccagtagaaaactgagacggagaaacattgccagaagcattcacactcgactgctttatcgacgtttttgatatagagtttggactattagtgttggtcgtctttgatgaagaagatgaatgatgaagatggtagtggtggtcattattgacatttgttaataatgatgatacactaaaagtggaataaacgtcatcgaataacagtgagactagttgggatatagacgttttatcagaattattcgaaccaccattatcagatgaagaagacggactattataatctgatgatattagattgttataaattttgacgtattcttttggccttgccattatccaaaataaaaaagctttggaagcataatataacaaaagcgaatgaaaaatggtcctcttcatgtaacttgacaggtgttgtagtatgtccagatatgctagcagattcttatcagtcaaatactcacaaccaaataaatccaagtggtttactacgcccaattcggttgaggtgtgtgatatcaataaaggtgcaacaacttttgttttgacacactttgtgaattcaacatgattggaagcagatatgaatctctggatataatctattgttaaatctattttctcggtatatgctggatagtttctcttttgtaaaaattcctgtgaatcgggtaaaatactcgattttgagatagtagcgctgccagaaagatggtgagacatgttctgtaaaacctttaaagttcttgtattgaacttcagcttagaaattttacatagtaacatcgtcgccaaagctggattgattctcgtgtgctttggcctagatgtatggaagtttggcctgtgacttgaaaatcccggtttgtaattatcgtttctaattttcttgaagtcattgttttgatcccagtaatactcaaaaacatcactcagtaatctcaaaagaaccaatatagaatgggcaatatcatctgtaatattgtcagacgtaatttcttcatcttgcacaatcaagtcaattaaacctaatgtgttttcgataatcgggttcaagtccttagtgatggctatattcaaaatgatggaccgacacgaattgaaaactgaatctgcctccacatcagcatatgttttcaaattagattctatgggaagaacaagtagaagcctatcaaaaaaaagatgcttggtcaaagagtattccattgggaaattttttttgtcttgcggatcgctttgattcattttagaaagagccttaatcttgttgtatgttatatgctgaagaagaatgttaagtttgaagctctatttgcagggcaaaagatgatcacttgactttatacgctttcgttaaatagcttaaccacgcgctgaaaactactatgagcccaatgccaataaaatgatcaaaggcgtaaatgaaaccggtactgtgtaataagcggaaaaaaaaaaaacagttaattgtttcaatcgtaatacaaagcgaaaacctttagtatattagttttatatgagcagtaactcttgttattctccttcgaacactgttcatttgctcatcttttacttaacgtttttacacatctttctatattgtatccctttatgaaaaacttccaggcggtgtcggctcgcttagagggtaataccaaaattgttcaacccagggccgtcgttaaccttgattcttttggaaaagctactcggctgcggtgaaactacctgcaattgatacaaacaatagtacaacttattactttgatggctattaagcattatgagcccgatagagccgaggaggttttgtaacagtgttttgtcgcagtatcttgagtgcgtcacacaggcttgtggcagaacaataaagatgtagccttgcggcttgagaaatttgaccatgcgatggcacattgcaccgcgatccctgtgatttttgacaaaatttagcactagagagcatgatatcaggtcgaatttgtcgttttcatttctcggtagcggtctttccataaaatcctgcttaataacgccttcatgttcctctaaatctatacgaaccacatttctaaaaagtgcacaacgggatatgcgatttccggagctcaatgaaccaatttctaatgccactgctccaggacaattttcaaatgaggacctgatccatttctcgagcaacttggacgtgtctcctcctcgttccttcaattgcccgttttgactggcaatttggtaagtttctagtcctcccaatttattaatctgattcattatgtaaccaagtaatgtgtacatcacagccaagtcagaagtatcctttgatttggattcatttttaattaatgagtgcagcctcagtagttgtgattccatagcatcattgaaggactgcgatttgccgtcttcatagtacttgcccagtcttacattacctttaatacttaacctgataattttgtcattcttctcctcgttggaatcatctaggttttccttaaggcataaaaacttgcatatcgattgacgcttattaattaaatggtggaatcttcttattatccttcttgtcttctgtggcttgattactctcgtcacgttacttcctacttgcttcctcttgcccgtaatactcttcgactttcttgaatgcattccgctgtattagtggtatcgctaagctgatacaagattgccatcaaggtcatggctagctcatcgatattataattgttatattttttttcacctcacaaacccgcctcaaggttagttagtccgtacttttctttttctctgaaaaacttttccagcgatgagcttataagaatttccatctaaaaaagttatattcgccaacctgcccatcattatcatcataacctcaggtagaaattctttagtcaaataccggcataatcagtttttccatcatgggtaagaaaagggctcctcaaaaaggaaaaacggtcacaaagccacaggagataattgtagatgaatccaaattgaactggaaaccagtagatattccggacactttagatgactttggtggattttatggcttggaagaaattgacggagtggacgttaaagtcgtggatggtaaagtaactttcgtcaccaaaaaagattcaaaagtgttaaaagatagcaataaggaaaaagtcggagatgatcaggaatctgtggaaaatgaatcagggtcagattcggagtccgagctccttgaattcaagaacttggacgatattaaagaaggagagttgagtgcagcatcttattcatcatccgacgaggatgagcaaggtaatattgagagttcaaagttaaccgatcccagtgaggatgtggatgaggatgtggatgaggatgttttgaaagaaaacgtctttaacaaagacattaatatcgatgatatttctcctgtaaatttacctgaatggacgaatcttgcacctctctcaatgactattttgcagagcttgcagaatttaaattttctcagacctacagaaattcaaaaaaagtctattccagttattatgcaaggcgtagacgtcatggggaaagcctctacaggttcaggtaaaactttagcctatggtattccaattgtagagaaactgatcagtaacttctctcagaaaaacaagaaaccaatatcgttaatctttactcctacaagagaactggcgcatcaagtcacagaccacttaaaaaagatctgtgagcctgttctagcgaaatctcagtactcgatattatctttgacaggtggactctctatccaaaaacaacaacgtctattaaagtacgataatagtggccaaattgtcatcgcaacaccaggtagatttttggaactgttggaaaaagacaacactttaatcaaaagattctcgaaagtaaatacgctaatccttgatgaggctgataggctgttacaagacggtcatttcgacgagttcgaaaaaatcattaaacatttattagtagaaagaaggaaaaacagagaaaactccgagggcagtagcaaaatttggcaaactttgatcttttctgcaacattctccatcgacttgtttgataagctatcttcttcccgtcaagttaaggatagaaggtttaaaaacaacgaagatgagctaaatgccgtaatacaacacttaatgagcaaaattcacttcaactcaaagccggttataatagatacaaatcctgagtcaaaagtgagctctcaaatcaaagaatccttaattgaatgtcctccattagaacgtgacctatactgctattactttttaaccatgttcccaggtacaactttgatcttttgtaatgccattgactccgtgaagaaattgaccgtatacttaaataacctaggcatcccagcttttcaaattcattcttccatgacacaaaagaaccgtttgaaaagcttagaaaggttcaagcaacaaagcgctaaacagaaaacaataaatcattcgaatccggattccgttcaactctcaacagtattgattgcaagtgatgttgctgctagaggtttagatattccgggtgttcaacacgttattcattaccacttaccaagatctactgatatttatattcatagatcaggcagaactgcaagagcaggttctgaaggtgtctctgccatgatatgctcacctcaagaatctatgggcccattaagaaagttaagaaaaactctcgctacaaaaaatagtgtttcgacggatttgaactctagatcaactaacagaaaacccatcaagtggcaaaacactgtgcctttgttaccaattgaaaccgatatactttcacaactcagagaaagaagtagattagcaggcgaactggctgatcatgaaattgcttctaattccctaagaaaagatgacaattggttaaaaaaggctgctgatgaattaggtattgacgttgattccgacgaagacgatatatcaaagagtaattcggacactttcttactaaaaaataaaaataaaaaaatgcagaagactataaataaggacaaggtaaaagccatgagagctacgttgaacgaattgttatcagtgcctatacgtaaagatagaagacagaaatatttgacaggtgggctagtgaatttagctgataacttggtcaaaaaaagaggtcataattctatcattggtcatgaaaagacaaacgccttagaaactttgaagaaaaagaaaaagagaaataattaatctcgaggcttttgaagagaaactctcctttcactgtattttctacgtaatatacacggtcctctaaacccactatgtactttcaacaaaggaattagctcaatatagagcaaaaggtttaccaagtatatattatattgtacaaaaaattaaaagcgaatttaatttaaatctggcatctagtgattaaattctttttgattcgatttttttctcccccttttatttatttaaatgaaatcatagtcggatccttcatcttcgtcataatattcatcctcagattcatcaactagttgttcaaaattaactttgtaacgcagcatggcaccaataccaccaaaacctgtgacaaattgggcaccttctgaagatttgtctgtgatgaattccaaggtagcaccgaagtttttgtagttagctgctagccattcaattaaaggttcttcggagacaacgtccatttcttggccggtagctttgtcaatagcaaacgacttgtccttggcttctggttcagcgaattttataacctcattatcctcggcatctttaaatgtatatctgatagtttccaaattttcgaaaacaattaatttttcgactgcacctaaatccaatgcctttaaagtatcatctataccataacagaatttaccagtgtcctgggaaatttcgtcaaaatatgcctccaataatttcttttcttgaacatacttgacattggccaacgcttcggcagaaagttcgatagcctggttgaaaccgttttcaccaccataagaaacatccacgatggaaataaccttacatgctagtcttggatcgaataattcagatttagccaaatcggtcttaaagtcagcagaaccagctaaaattaaacccttaacattgactttgtcattagtaataaaattttgaacagcaacttcggcgacctttctcacataattatgtcttttttcttctcttaaacgagcaaaacgaagcgcagattgaccacctctaccatgcttttttggcagatcgacagtaaatttatgtaaaacagttctcgtattaccggacacagaaccaaacaaagtaccttgaccgtccatgactataaaaccgaacttgtcgtcagcttgaagcaattccgaaagaacttctgtatgaaatttgttatcacacaaatataaggatgtgttgataggtttgtaaggttcgatgtcaaaagtgacctttttttctttaccatcttcagtgatgatatcaccacaatataaaactaaaccgttcttgggcaaagtattatatagcttcaacttttgttgggtggaagtgatagcagataaaacggaaagacgattaaccctagatttaatattcgaggcagtaccatattcatctgttaacattttttggtacagtggaatttgacccttaggaggaataactaaggaaatcatagaagtaccattacctctagctttttctaaagattggaccaacttcttgaccttccagatctcaatatttttttcaacctcgttatccattattgaagtatttcctttgtctatttctgtagtcttaataaggagacaagccgaaatgaattaagaaataaaggtgtcgttaaggccacaccaacagtatatcagttaaaaatacagtgatgtatttcattgatttgacgcttagcactggatttctgaaaaaatttttcattcagggtcaacggaataatccgggtaataaagacggcgctatcaaacggtattactgaaaaatgtacaaatgatgagagagcaagtgacttaagtattcttcgtacatgcggtagcgacagattgtagtttatgatctggttataataccatgtataaattggaaggatctaagctaaagtaaattatgaattgaatactgcccttcaaaaattagattttgacaggatgctttttaacaagtctgttatcctcttcatggaatcacaaatttaaccagatatttgcagcagctattgggggaaatgatgtagctaaggtctacctcatactgctcatatccagctttttacttacttttcgtttcaaggctcccatactatctataatgagtagaaatatcagatgactatgtcattttgaagttggttagaatttgctttttggtttcgacagcatgtgcacattcatcattgaccttcgctaaaggtagcgccaccaaaaaggagcaatgaattgaaataaagttctcagtcctctacttgtccagttcttggcacattgtagagtcttacgtcaaatgttctgttggctcacatacgtgctcttcgtattttccatgaataacttcagctatttatgtaaatgacgctcatactctttataaatctgaaaataaatagcacgcatatacaaagtggatcaagaggcgttatatccaaacatttcagacagaagattatataatgtaacagaaaaagttttaaaaattttggaataaaggaaaaggtggttggggaagagaatagagctacagcaagtaaaaaggtgctttcctcgaagttgcgtcgaagatgaatgaaagtagttgctaattcttactagcacatgaaaaaaaaggatatatataattttacaagtagtgtcttcatgacggattcatagtctatccaagcgtttgcccaaaattttgcagtaaatttaatgttttctgtataggataatggtgcgccattcaagtcccgcgaaaaatgactgatgtctacaggacaggggcgcaatatatgttctctgacattgcaccttttgaatatatcatgtgtttgttctgctatctgcttgtagaagggtacgctaacagagccggcggcattgtaaaaagttctcctttcgcggaaggatgagtcaaaaagcatgtgacaatgaaataatcaaattgtgacatctgctgacgcgggatcgttccttcgtattgtctagattgtaatctatataacatactacgaatataaaagagggactacaagatatttctagcgcaaactactgctttactgtctcacaatgtctctgattggaagatacctaagaaaattatttaactacatatctacaaaatcaaagcatcatgccttcgcaagtcattcctgaaaaacaaaaggctattgtcttttatgagacagatggaaaattggaatataaagacgtcacagttccggaacctaagcctaacgaaattttagtccacgttaaatattctggtgtttgtcatagtgacttgcacgcgtggcacggtgattggccatttcaattgaaatttccattaatcggtggtcacgaaggtgctggtgttgttgttaagttgggatctaacgttaagggctggaaagtcggtgattttgcaggtataaaatggttgaatgggacttgcatgtcctgtgaatattgtgaagtaggtaatgaatctcaatgtccttatttggatggtactggcttcacacatgatggtacttttcaagaatacgcaactgccgatgccgttcaagctgcccatattccaccaaacgtcaatcttgctgaagttgccccaatcttgtgtgcaggtatcactgtttataaggcgttgaaaagagccaatgtgataccaggccaatgggtcactatatccggtgcatgcggtggcttgggttctctggcaatccaatacgcccttgctatgggttacagggtcattggtatcgatggtggtaatgccaagcgaaagttatttgaacaattaggcggagaaatattcatcgatttcacggaagaaaaagacattgttggtgctataataaaggccactaatggcggttctcatggagttattaatgtgtctgtttctgaagcagctatcgaggcttctacgaggtattgtaggcccaatggtactgtcgtcctggttggtatgccagctcatgcttactgcaattccgatgttttcaatcaagttgtaaaatcaatctccatcgttggatcttgtgttggaaatagagctgatacaagggaggctttagatttcttcgccagaggtttgatcaaatctccgatccacttagctggcctatcggatgttcctgaaatttttgcaaagatggagaagggtgaaattgttggtagatatgttgttgagacttctaaatgatcttttgtaacgaatttgatgaatatatttttactttttatataagctattttgtagatattgactttttacgatttatttgtaacaatgagaattactccatttctgaacttcagtaaatagcgagtgattctgtactttgcgagaaccggtggacatttggtattttgccttacaagaacaacctatacaaacgtttcaatatctaattctttgtaatccattgttttacgagacatataatgtgatatatagatgaactttacgtataaaatgatatatttaaaactagcaactgcgtgcgtaagacaaactgaaataggccatttacggaaaagaaatttaataatgtcgactggaaactgaaaccaggaggagtagaaattggttaaattgattagctaaaatttactcgttgtggacagagtttgagccaagcggaatgttttcaaggctttctttgtttcgaagggcagctctggctcctgcccctatgagaatgtcttttaggactatttatcaaaaaaccgaggatgaattgcccagaaggatcgtcccaaagctagccacattttattcggcgaatcctaaccatgaagatcgtattaatcgactcgaaagacttctaaggaaatacataaaactgccatctcagaacaacaatgaagcacaacaaacaaaagctccttggatttctttcgatgagtacgctttaatcggcggtggtacgaaattaaagcctacgcaatatactcagctactgtatatgttgaataaacttcacaacattgatcctcaacttactaatgatgaaatcacatccgaactatcccaatattataaaaaaagttcaatgctttccaataatatcaaaatcaaaactttagatgagtttggaagaagtatagccgttggaaaaaggaaaagttccactgcgaaagtattcgttgttagaggtacaggtgagatattagttaatggtcgacaattgaatgattacttccttaagatgaaagacagagaatcaatcatgtatccacttcaagtgatcgaatcagttggaaagtacaatatttttgcgacaacgtctggaggcggacctacgggtcaggctgaatcaatcatgcacgccattgcgaaagctttggttgtgttcaatccattattaaaatccagactacataaagctggcgtcttaacaagagattacaggcacgtcgaaagaaagaagccaggaaaaaagaaggcaagaaagatgccaacatgggtcaagagatagtcttagtgcatcttgttacctcaatttcgaacggaagcgtgcgtgctctgagttttttgacacatgccagaagaaacgttatatattttgcatacaacgccgcccagcattagaagcacaactctcgttcgttattcctgtaaataaagttatatgtattcgaatattgctcagttagtattttcttctacttactgcacataatacttcatcttttttttcctctcacccgcaaagcaaaggggccttgcagcaatgactcaaattccattggaaaaaagaaggagatgataagatgcaaatcagaatagattttactatgaccgttacatgtaaaaagagtcataatataaaccataaatactacaaataacaccgggttcaggcatataaataaactattctcctgtaatatcccacaatattttgttataacccagacgtaatagcctcaagcgagcatccctaaatttctgccatgaagctgatcccaattattttgaatgctaagaatctcagtgggatggctggatccatatcaatatgctgttggattgttgtgtttgtaccacagatttatgaaaacttccgaagacagtctgcggagggattatcactgcttttcattgtgttgtggctattaggtgatatatttaacgtcatgggagctatgatgcaaaatttactcccaaccatgataattttagctgcttactatacattggcagatttaattttgttaatacagtgcatgtggtatgacaaggagaagaagagcattttacaagaagtcaagaaaaatgttgatcctgtgcatttgcctccagcaaaccccataaatgagactgtcttacaagacgtttttaatgaatatgagccacttttgccaaggatagaagaagaagatagccaatcgtatagctcgcttgagcttggcagaacaatagtcgtaaaggaaagagagaattttttcaatgacttcttaattgtttcaggtgtacttattgccggaattttgtcatggtatatatcttactgttccggcctagataacggtattcctaaaaaaaaacctgcgttcgaacagattaatttacctgcacaaattttagggtatttaagtgcgatactgtacttgggctctaggatccctcagattgttcttaacttcaaaagaaaatcatgcgaaggagtctcattcctattctttttatttgcatgcttagggaacacttctttcataatctcagtgctctcagcatcttggcttatcggtagcgctggtacgctgttgatggacttcacagtttttattcaatttttcctttacgccaaacctaaatacgagaaaatactaatagataattaactagttggcttctattaatctttccacttaaaactcaaacttactcatatgcgcatcggctatagcccagaactagtattttcattttatggaggaaacaaaattactagcgccatcacggctcagtcgttattttggcgatgccctttgctgacacgcgtctgaaaaaatacacaaaaaataacacaaaaacgagtaatgccatttcctgggtggggtctctatccatagaggaaaaaaagtgacaggaaggggacaaattcaactattcactgtagtcatctaataatttttttaacttaatcacaccaacaaaaacaaaaaaaagctaaaactaggttgaaggattttaagagaagttattgcaccggtgtattaacatatataaggatacgtacgaacataacatcatgtccagcttagccgatacagtagagggtagcgaggccaaacgcggcagattttccaacaatgcattaacctccgatactggtattttacagaaaaatagtacattaagaaactggtttttaaaaccgacagcagacctaaaaaatagttgcgaagatagagttgaagatgacgtcaatgatgtctacttaaatgacaaaaactcacaaaaatctgttgaagaaagaaaactaggaagaaaagttagatcttttttcaaacaaacaaactcaaataaggacgagtctgtgttggaagatgaagatgatgcgttagtttggaagaaaactagcaataagtgtgcaaaaaaggaaaattcccatgacatccaaaaaggaagtttcacaaaaaaaatcagaaacagtattttcaagagtgcaaatgacgtgaaagaattcaggaatgaaaataacttactattgcccgttgaactttcttctgatgatgagaatgagtctcatttcactgatgctaactcacatgttatgcaatcaaaaagtcccgagaaaataccttccaaggatcaatgcttgactaaaggcgctaagaataaaggtctgaaaaaggaatatgaaaaaagttttgaagagtatagcgacgacagtgacgatgaattttctcctgctactccaccggagaatgttcttgaaggtccttacaaatttgtgtttcagacaccaaacacatttacatctcagcctaatataacagtagaaaatgattttcacaaaggtgggagacatgtgattgactatctgaacaaaaaattggctactatgaacattgatattgatttgacttcaggggggaaacaaaacgtatcttgggaggaagagctcgaccaattgagcgaccacgttatagaaagtattactaaccacatttcaaagggtagaatgcacgcacaagagaagcaagatgagttggaaaagttaaaattggagaatttgaacttgtcaacattaaagcaagaaaatctccaacataagcaggaaattaactcattgaaagacaaccttgaatccattagtaaaaaaaacaatgatcttatattggaaatgaacaaattgaaaaaaaaaagtacgaataataaaacaaatgagtacatatctacggatgaaaacgaaaatgaggagattaccaaatccaatatgggtcctggcattttagaactgaacgtcaacgaaacttcaaaaaaattacagcaatccacattcaaaccctcgaaatatcttccaagagaaacgagaaacaatgaaaatagattaaaacacttggaaaagagaatatttggcttagaaaaatctcttgaaaaaaaaaaaaaacaggtaagggctgacagcgttagattagacttgaatagatatactatcgaccagtttttgacattactgaaaagcctcagcgaggttttgcaattccacaatgtttatggcaatgatttgaaggaaaacgacgataatattataaagattgaaacctgctgtagtgcgctaaacatgaaaaattgtttcgaagactcctcatttcgtttacaagaaaacagcttcaagaggcaattgggccctctgttcgcaaacatcaacttctccttaatcgaccaactgacaatgaacttcaggttctacgagagatctgccaatttccagaaggaaacaataggtgggttaagaatgatgctacaagataaggataactatatcaaaacactgatgcaacatttgaagaaaaaagagagtacaaagttgataaaagacagcaagaatggcgcctccaccttaacatcttaacaatttcgtttactgaaaatgctactagtatataatcattaagtatctaactatcactcaataaaaatattatagatcgcttaaaaactcgtttattgccgattataaatccaccaaaagccgctctacccttacctccgcctggaaaaattataatatataaagtgagcctcgtaatacaggggtaaaaaggaaagagggggatatcaagcatctggacttatttgcactatctccgccttcaattgataaaagcgtcttgattttaatcaactgctatcatgtcttcttcagtagcctcaaccgaaaacatagtcgaaaatatgttgcatccaaagactacagaaatatacttttcactcaacaatggtgttcgtatcccagcactgggtttggggacagcaaatcctcacgaaaagttagctgaaacaaaacaagccgtaaaagctgcaatcaaagctggatacaggcacattgatactgcttgggcctacgagacagagccattcgtaggtgaagccatcaaggagttattagaagatggatctatcaaaagggaggatcttttcataaccacaaaagtgtggccggttctatgggacgaagtggacagatcattgaatgaatctttgaaagctttaggcttggaatacgtcgacttgctcttgcaacattggccgctatgttttgaaaagattaaggaccctaaggggatcagcggactggtgaagactccggttgatgattctggaaaaacaatgtatgctgccgacggtgactatttagaaacttacaagcaattggaaaaaatttaccttgatcctaacgatcatcgtgtgagagccattggtgtctcaaatttttccattgagtatttggaacgtctcattaaggaatgcagagttaagccaacggtgaaccaagtggaaactcaccctcacttaccacaaatggaactaagaaagttctgctttatgcacgacattctgttaacagcatactcaccattaggttcccatggcgcaccaaacttgaaaatcccactagtgaaaaagcttgccgaaaagtacaatgtcacaggaaatgacttgctaatttcttaccatattagacaaggcactatcgtaattccgagatccttgaatccagttaggatttcctcgagtattgaattcgcatctttgacaaaggatgaattacaagagttgaacgacttcggtgaaaaatacccagtgagattcatcgatgagccatttgcagccatccttccagagtttactggtaacggaccaaacttggacaatttaaagtattaagacaacgactttattttcactttatttagttcgcttcttaatcttgtcaaaaacaagatattgtgtaatcgcctcaagtaaacaatatgtttttcatacgtgatttgaagtttttaagtatctgaaatacatacgcgcgcgtatgcatatgtattagttaaattactcgaatgtcctttatataatattacatttttacacacacattcttgaagaagaaatcccgatcgtaaaaaaaaacaccgtgctccaaatggccttcaatcttttcgaataatttattcgattgttcattctcatctctataatcattcgccgtacgttcaggatatgacgcatcaagcagcgaagctaaacctgttggaaataaagatctgtcatagtcatcgtcttcttcatcatcatcagcaccattattactataatcatcatcattgtcatcatcatcatcatcatcatcatcatcatcatcatcatcatcatcatcatcatcatcatcattaatattgttgtcattgtcattattgttactgttactgtagttattgttattattattaatagtactactactattattgccatttttattattattattattattattattattatcgtcagtatcatcagcgccagtagtctcgttattatcagtattggtaccattactatgatgatattcctcgcctggctcaagagttttattttcccacaatttcggaatgcttgaaaattgcaagaagttcaaatcctggattgttatttcattgaaaatattgaaggacacttccattttttcttggtcctctgtaacgaaactaccaaatgcagccatcttctctttatttatgaacgaagttttcaagagctcgaccatatcatcttttgattctctcgtatgcttaactaacctattgagaacaccctcataataatttgaatcaaaggcatagaattttgcgtatttacttgtcagattgaacttttccatcgtactccgtagaaaaaaagtgtaaaaaaaaagagatgtttgccacttcagattgtgtactgaaagacagcgttcttcagatccaagcatacgggtatgtgtatccctcaataatccaattatataaccagtctccatggcatgttcgtcattaaccataatctctgacaaatacagaaacatggaaaaaaccgttgtgagagaaaaatacagaaactcattctgaacagtagggtagtattcaaaatctttcaaaatattaagtacttcgatgcaatttcgcttgaaatccaatcttgaccttctaataatttcagctatatcatgccgggaactttcccgttgatctaagttatctccaatgatggatatgacaaataaactcagggttatcttttgatggtaccatctgaggtgtaatagaatagtagtacaacaactcacttcaaaatctaacttcgaagaatccaaagataaaatcctcatgttttccttgtaattttctaatgataatatggtgggcaaatcgtctcgcattctatctaacgccttttgattttccagtacattttcaatgatttcatctagtgtatcgtctaaagttgttctgatggaaaaacatgagtaatatatttgagactctatgagggataatctcgacaaaaaatatgattgaatgtatggtacatattcaaggtgattcgcgagtaagtttacaacggatacaatatctttcaccccttctagttttgaatcatcgtattttatagaaagattgggcagaattttatctctgaatagttcaacatagctttcatctgttaatacatcagtgttttcctccttgagaaagggcggtcttgacaacaccacagaaaagaatttgtctgttgaaaaacaataacaccacaagcgtcttcttttaatgatttcatcaagttctagatcctcataggtggaatgtaaattgagccgtaaatccaaagccactttgatagcaacggatagtactttgaccgctgatgaagcacttattttttgttgggcaaactttgccagtaacagtaatgcctttaatgccgtcatatctgcgcgtgctacagacagtttatggtagtaatagacagaattgagaaaagtgaaagatctgagtctccataattcgaacttctcaaaataataggtttcatgattatcttcatcaactagctcctgcttctcctcaaaatttgtaacggtggccccaaggcagaggcagatatttagcaaaaatgcctgtgatgatgtcaatcttcctttagcaggatcaaagtgcacgtcggcaaattgcaaacattgatctacatccactatgtggagaagagaggctaatgatggacattttatatttttgagcaaacgctttgcaattgctaaacggggcagaggatacaaaatattatcactagatggtgatgatgcggatcggaaagagaagtccaggaccagcttggtctgtaaaatagaatatttgaaagtagtagtaaacatttcattaatgggcgaaagaaattcttcgtcagttaaatgtgataaaacattttgtcgaaaatgaaacattttttgttttgttaacaaggcctttgaatattgctttcttttaggccttttcatgtattctttatcaatgacgtcaattttgcttttttcagctagcttctctattgttcccttcatgtttttacaaatctcttccaaaacaaaaactttcccagcaaccttcgtatggttgagttcaattttttcaagcactgtcctgtcaataggaacaaagtcaggccaagtatcttctttatcgcttgcacttttgccggcagaaactccaatatattcttgtgataagttggtgtgtaatttcggcgagctgtctgtagaagaagtatttcttgatcgcacggcgatatcaaaattttcatccttgaacttattctccttatccaacctcggcttcttaaccgacttcccatttcccttgttattcaaagcttcttctcgccttcttttcagttcttcatggaaatgaaacgtgcaatctttattatacttgatacagtttctacatttaccagaaatcggctcgatttccgtacatctaatcttcctcttccgacaataatcacatgctttagtcactctacttttgaaagactccatgttatatgccagaaaattcttatcagcaggcatcatatgagctaatgggtgatgtcttaaacggtgatccggaaaagggctcaactgaggcgacattattgtaccagttggaacaggcggaaaatttgatggtactggaggcatcgcagggacagcggggcccattaaaactcttgtattttcgactctttgattatgtttctggttagctgcccactcagaactttgcttttgtgtcttatccatgcttccatgactacttgtaataccagaatccatattcattcacacaactcctgctgggcttgtaatcattgttaacttaaaaaagagtagtcgtaatataaagtttactctattttaagtagactttgggcagtggctgaaaataggcatgataaatcaacattttctggcggagtagggtcaaaatgaaaatgtggaccctttagggtattataaatattttttaaagggcaatttgaactttttaggtgcaaagaaaattctgaaggtataaaaaagagggttcaccggtgctgcggaaataaaagcggaaataaagatggaaataagggctaaaagtttcttaaaacaagtgcaaggagagggagagttccactcttggcgctgatgatatcttctatttatattgttgagatcatatgatgataacgcaaagttgaaattctaaccgaatagtagtataacatactggttttctttctgttcgaggtataagaaaagaaagtacttggctatattcggaggaggcaagaaggcggccaagagagagatatcttctttgtcctttgaattatggcttttttgaatattttcaagcaaaaacgtggtgatgaagcttcacaactgagcgcaaagggacgggaggaaatttctcaatcgattaagatatgcaaaagtgacgatgctgctaacgaacatagctgctctggtgattgcaaaacagaaattgaagaaggagagcaggcctttgcgaaactaaagatcgaacatgaaactcctttgttgaactcttctaaaacgccaaaaattcacttcgttgtccccacctctcaaatcgattggcagcatgatgcctgcctcgaggacccaaagtcagtacagtataaaatttcccagtggtgtgataagaattcagctaaattttccaacgtgggcacaggcaagacactaaactgtgcagtttcatctttacctaaagatatcatggatattgatgttatgcggggaaccaagaataatgtacttattttgccttacttcatttggctgaacgaccttagatcagatgacgtcgaagcaacgctggatggtttagttcctgacttattagacgagaatatttcaagagagaaattgctagaaacacgaccaaatgttgccgttgcacgtgaacgtgcatttgtatttatatgttcacatactacgagggataaacgatgcgggattacggcaccctatttaaagaaagtttttgacagtaaattacaggaacatgggctgtatagggacaattcggattacagggcagagggtgtcaaaattgcatttgttaatcatgttggtggtcacaaatttgctgcaaatgttcaaatttatttacgaaatccaaataccttaatttggttgggaagagtaactccaaccatagttccttctattgtcgaacatctgattgttcctgaagaaccaacgttgccgtttcccgaaaaagttcgctgtattaagaaatatcaaagctggtaaaggttggccagcaaaatacaatcttttgacgccataaaatttgccatcagagtagcttttaaatgtacatagttctaaagcacgcatatatatttataacgctaagatgataatgaaaagttttatttgcaaaagggatcctgtatttcaactttccatacatgaaagattctttggccattttcttaatccatttcatattttcatctgattttttttctgttttccacttgctgctcattatttcattttataatttttgcaaacatgcaatatttcgccatatattgagaaaagcaattcttcgttgttcccagtaaagaaagaacaaatgcagatttctaccgccaccgctagattaagaattttttttggttactgatttgaatcacatacgatgagttttagacatttcaagaggagacttgacacaagctcagcagatgaaagctcttcggcggatgaagagcatccagaccaaaacgtatctctaacagaaaaatcagcctcattaagccatagtgatttgggcggcgaaattttaaatggtacaggaaagaaccgcacccccaatgatggccaagaatcaaatgaaagtgatgggagtcccgaaagtgatgagagtcccgaaagtgaagaaagtagcgacaacagtgattcgagcgatagtgacgatatgagacctttaccgaggccattatttatgaagaaaaaggccaataatttgcagaaagctaccaagatagatcaaccctggaatgcccaagatgacgcacgagttctgcaaacaaagaaggaaaatatgataaaaaacatcgacaaagctaatcaagtggcaaagaactacgaaacgatgaagctgagacttaacaccaattacagcaccaacgaagaattgatcaagcagtgcttgctcttagatgataacgatgaagtcgattcagaaaaggagagacagaaatggtttgaaaggcagaacgaacgaaagcaaaagcatagaagaatacaacttgcgaaacaaagagaatcagaagaatatgaggcaaaacgatttgaagcgatgcaaaaaggcaaagatgggaataccaaatacgacgttatcttggacaaggagaaagagaaacttgatcacaaaaaacaaagatcggctgaaaaagtagaaaaatctcacaataacaaccgttacaagattacaagaactaaaaatgttgaatttggtgacctaggcaagaatagtagagattacgaagaaactgaatattcggttatataacaccgcatcacacacacaaacccacatgcctttcagttagttgatgtcgggaaaatcccgaaacagaaaaaagaggcaaagatgaagatatcaaattttttcgcagaaccattacatctggctttggatacgatgaaacaatctagcagaaatacagtaccaacctattggtagcttctttgtattactatcaacaattttagaagatatgtctttgacaccactgtgtgaagatttaccacaatttctgcaaaactatctaccgaatgctggtcaaacggaaaataccattgtgccctttgtcacactaacttatgctcaatcgctcgacgcgagagtatctaggggccctggagtgaggactacaatttcacatcccgagaccaaaacaatgacgcattatttgagacatcatcacgatggaatactcgtaggaagtggaacagtgctagctgataatcctggattgaattgtaaatggggtcccgatccggctgcaaattccccaaggccaataataatagatacaaagcaaaagtggcgatttgatggttcaaaaatgcaagaactttttattaaacgacagggtaagccgccaatcgttgttgtcacaagtgagcccattataaaagaacaacatgtagactacgcaatttgtccaataaatgatactacgaaattggtcgattggaagaaattgtttgagatattaaaagaagaattcaatataaggtcagtaatggttgaaggaggtgccaatgtaataaatcagttgttgctgaggagcgatattgtcaacagtcttataataactattggatcaacatttctgggtagctcaggcaccgaagttagcccaccccaaacagtaaatttaaaggatatgtcatggtggaagggcattaccgatgtggtgctttgtgcgagactggccgatgactaatagtgttagaactccaccttctgtgtaatttctttctgaaattagtgaaaaaaacgcgcctttcaaattttcatactagtgattggtttattgcagattatttatttctaattgtacatattcttgttattttatattatatgaaaggggtaaatccaaatgccactctacatacagattctgtaactggcataacgaccagaggtttcactttttcttatgattttaactacttcgcctcttttcaatcccaagtataaggctacaggatcagctctttgaattcttggcaattgggattccttcaatctatacctttttaaaagctctcttttctcatcactactcaatctgatatgctttggaaccaattcgtggtgagtaatattaaccactaaggcagcttcattaaaagtttcaatggtggctggtggtatagaaggcaccaatttcattgcacttggtgtaatattattttggtaaacaaagatacctgtttggaaatttttttcttgaatatgtataacaaaagtcttcattgtctttacaccaacggaaggctcatcacaaaattctacccataaggagcccatgtctgggaactttgatatagattcttctgttggatttgcctggaaggacatcattttacgttgtggtctgcccatggagtcacaatacttggccttgaaatcttccaatggcaattcgacttcctcttgagtgataaaataacccctgtccttaaccatttcttttactgttctgaatgctctccataatcttgagatgtttctttcattttcttggtccattgtcttagcttattagtaatatccacctgcgcacaaattttgtaaatcccctactaatttaatttgaattcaaattggctcgtgatctgttgacccttgttagcaacgtttgtaatcttcctcaccgaattgcgtcgttttgaataatatatatgattgaaaatttttcaagagaaaagaaaaatttttccttccgcggtcagccattgctaaaaaaaggcctccgttaggagtcgaatagaggacaacaacaatacattgccactttaattttaaatgcttgcatattaactagcgatcagatgctctgctctatataaaataaattattgatacggtttctagtctcggttgatgataagagtacgttaatccacctaccgagcattaccaagatatctggcactttatatgtagagagtctgtgttctcaagtttacttgtgcggataatgagcttaaagacttaaatactaaaagcgtatgcgttcgtatctctgtttaggcaccttgtacagtttcacagaaaactgtgtaatgtgtgattatagtacacagaacaaaataacttcacctcatctctttcttaacgcagtgaggaaaaaggtggaaaaaaaagaaagaaaaaaagaatatgtgtaatttccggcacttttcagagcgatgagcttaaattcaaaagcagcattgaattaaaagtgaggtcttgagcactacattctagcaagtaaaagaaaagaataaattggttttgcatctagaatgagctccgttaacgcaaatggaggatataccaaaccacaaaaatatgtgccagggccaggtgatcctgaacttccaccccaactatccgaatttaaagataaaacatcggatgaaatcttgaaagaaatgaacagaatgccttttttcatgaccaagttggatgaaacagacggtgcaggtggtgaaaacgtggagttagaagctttaaaggcattagcttatgaaggcgaaccacacgaaatcgctgaaaatttcaagaagcaaggtaacgaactatacaaagcaaaaagattcaaggatgcaagggaactttactcaaagggcttggctgtagaatgcgaagataaatcaataaatgagtcactatatgccaatagagcggcatgtgagttagagctgaaaaattacaggaggtgtatcgaggactgcagtaaagctctaactattaaccccaagaatgttaagtgctactatcgtacaagcaaggcttttttccaattaaacaagttggaggaggccaaatcagccgcaacatttgccaatcaaaggattgacccagagaacaaatcaattttgaatatgttatcagtgattgatagaaaagaacaagaattgaaagcaaaagaagaaaaacagcaaagagaagctcaggaacgtgaaaacaagaaaattatgttagagagcgcaatgacgctgagaaacataactaacatcaaaactcactctccagtagagttacttaatgagggtaaaataaggctagaagacccaatggattttgaatctcaattgatctatcccgcattaattatgtaccccacgcaagatgaatttgattttgtaggtgaagtaagtgagttaactactgtgcaagaacttgttgacctagttttggaagggccgcaagaacgcttcaaaaaagaaggtaaggaaaacttcacaccaaagaaagtgttggtgttcatggaaacaaaggcaggtggtttgattaaagctggtaagaaactgacatttcacgatatcttgaagaaagagtcgccagatgtaccattgttcgataacgctttgaaaatatatattgtgccaaaggtagaaagtgaagggtggatttccaagtgggataagcaaaaagccttagaaagaagatctgtgtgaagtgtcaaatagttaaaaatatgtaacgcaaagttgtagatagaaataacaaagcaagaaggaaaagtaaagaaagtgaacgatatacgtaatgcagggggaataccagagtatttaaagtgtacttgatttaatgttaaccagtttgaatttttcttttctggggtaatcgaattcaagaccttttgggcacaatttgacgcggtttcaacctgtttagcctaggatttgggaaaatttcatcggtgtgcaaaggcggaattggtccaaagatagtttgtggatttatatcttgctgtcttatcaattgctcttgcaaatacggggatttagcccatgccgctaaagttacgctagcctcatcttcagaatcagtatttatctctggtaaagaatcattgacagaggctatctttggggtcacatttccgattatttctcgatggtcaactgtatttattgtggccaatatattgtcggtactaaatgcagtatttttgttgatggtatctcgcacatgattatcgaaaggagccaaagattcttttagacgtatgtccttgtagtcattactaaagcttgtttgcttttttagatcttgttccaaatgcgacatccttttttgtttctcttgtttacgccgatgatgttcctgttgagacctcataattcctgataaccttttatcaaactttttttttaagtcatctcgttctgcctctgctggtggaagtaattgaaggtttgtaagccgataatttttggatttacgagactctggcttggagatgtcagcaatattcggagaaagttttcttaatgttttctctttaattttcaaacgatgtggcgtttgcgacgttgttaaatttttatttttattaggcgaaatagacgcttttgttggtctcaaataacctcttacagggctttggtaataatttttaacttctttagatggcgagcttgaatcgacacttatttttgttggagaaatactgtgcggtcttgaaccagttttatgaacatcactagagtgtttggacttctttttctgttctgcaatgattgctagctttttgtgtgtcgttagcttcaaagaagtcttatcaaacctcggaatagaggattttcgagagttttttcctttgggtgaattatttttggttattttattttttactgagaatatatctcttaacgcttcttgcatatcagtatccgtggagtttattgacttaaacttttgagaaacttttttcatgggggagcctgttaaatcgattgatgaagaggagtatttgtgaccaacgtttccacgggaaattttgttttcaaatgattttgttggaatagatgatagcctatcgaaaacactggatgcttttgtagatcccgcggtatcactgttttccacagctcttatagcaggactatttatcgtagatttttttttaaatgcgattggtgattcctttactgttcgtacttttggtattgatcctgaagattttgttggtggaatgtgttgaataataagaggatctttattcggcagtggaacaaacatattcgaccttctttgagatctcgctatcccagaattcggtggtggtttcacctttactgattcagctttctttaaagcttgaagtataggttcattctccatttcttccttagccgcccatgtttgattatcgaagcgttttgtattaatcggagactccgaagtcttggaggattctcttagaaccttttcaactttgtaaggtgaccatggtgaggatttttcgctttcattggcgtcgactttaacgctattcaatggctcaaccgggcttttattggtatcatgtatactaaatctattcattccttcggtgacttccttcctgcggagtgatttaggcgtgatacttttatcgttatgtaatccatttctgggtgtcttagtaacgtcttttgcggcatcattctgggagttagaaagttcatattctcctttcattttaggaaattcgacatccattttgttatgcgtattttcggggctaattaaagactcttccatctttttgtcttcatacttgagtgtattcatataaacattatttcttaaccattcactactttcgtacaatcgttgatttatttctgaatgtgcatctgttgttagattatttagatcatcgagggtttctatgattgaacgggtagagcctggcttcctttgagttttcttcctagctgctttgattgcccagtccattgtttaaatcttcgggctctttcaaagtccgtcagttgaggagatactttgaaacgttttgtttgtatcattggcaatacttgaaacgagtttttgtttgttttctttttttagttaattcgcgaaatttaaaatatgaagatcggtttcagaacagaatggatcaggcttttccgcgtataagaaataataacactgacataacgctataacgaaacagcgtaacaaaatactctttacatggtttatttttatatattcatttaacattatcaaaactaacattaagtcctttatttatcaaaacaaacgaaaaaaaaaaatgcgagacaaatgatccagtcatttattgtcaatatctaagtcaattagtggttgcaatatgtctccagtttccactttatgagcaaaaattttgccctcaatatttatctgatttttttcagcgaattctttcaaactcccgaatctaccgcttgcgtttcttcttaattgttcattggtattcatgattgtgtttttcggggacatttggtgggtatatgaagtatccggtgaagaatgatattctttgtccaagaaagaacttgccaatgaagtttttcttgaattgacgcctatgcttgaattagaatcgtacccgtcaatgaaatttggcttacaagacctgctgaatgagattgcatgactttttctgtggtaacttttccttcgccctgaaggctttgtaagttcgtgtgataatgaacgtgaatgcgaatgtgatgataattcattactttctacccttaaaggtgataccgcattaggctttcttggacatatggaggaatttctcctcgttttcacaccatccttgtctccagggaaagagtaggtcttcagcttgttgaacagagcttcgccttgagactcttcaaaataaaagctcttttcgtactcatggggttgtttgctgctatcgaactgagattctgttgaagagagagagctgaaacgtccatagagtgggctgccaagtgatttaatggatgtactagattgactgcccgtagtaggaaaactaaatgtgcttattctttctctttctttttgctcaaatttgcccatatcttgctggaaagggaaacttcagtgaagtaataacgaaggtggtgtagagtataaatttttattaagtatgcgctttgacgttcacatatttgtaaaagatttatttgagaagatagaatgggtctcatttatttatacttaaatgcttctttggatgtcaagctttcttgatgccggacttgcagtcgaagggctctttcccaacagatatgtaaccaaatgcgtcgaatagaaaaagaaagtcttccaaggaaagtttattacgaggggttttgtgcattaacgtggcatataattaggtataaactcaaggttggcttaagattagcgaaacaaaagtataaacgacccaaaattggagtggatgtgttctttaacacataaactgtcgtacaaaaaaaaaagaaacaaagagcagttgaaagaacatcaagatcataaggacccccatatcgtgataatcattgatgaccaaatcgtgaactccctgcgcctatgccgtgccatagcaaataaagtactgggctggattgttaatgacttgcatattaacgacaggtaaacggtaccctatttttcttttttacgtgctacggacgaaaagtgagggtgattaacgcttcaaataagaaacgacggctagcagggtctagatgcgtgagatgagataaggaaaagagctctgtgtcccaggtaataatccctggagagatataatcttccctacaacttgattgcatattaacgctcccaagttgtggccattgaagagctctacagcaatgtcccgacgaacggaaataaccctctttttcatgatattttcggagttatctccactgtcaacaactattctcgaatataacagaatgaaagggatcacgtacgcttgttatattgctgtcgttctccgttcgcaatcccattatatgcgaggggcaaaagaagagacggccggtaactcattttttggtgtgtgagaattgcggaagcttcgttctcccaccttttttcgctgtgtttttcttgtcctcagcaccggctggtcaagccggtgctgaacggccggagagaaatataaacggatgaaaacgtgttaataattgcatcagtagtaggtggcggggttgtctcatttttgttatggcgtaaggtgaaaaattgtaaaggattggttcggttgggttggcgacaattaattatgggataaaaaattgcttaatctttattggagcaattacctgcataggcactcataggccacaagggtttgatggcggaaggatgttatacctacgatactaccatacatgtgatatgtcactttctagtccgaagcgtggaacatattatcttgtttgacgttgtgggtgttaaccgtaattgtctgggtacgccgaaggcacggagaccatgttaaaatatgtttctcttttttgctcatttttttctattttttgctgcgcattgcccgaagcttttcttagtggtagtctgctctcgcgctctttgttacactcgcaaaatttttttgctgggcaaaataaagcactctccggccattactggctgtcgtccgccaggattttcattaacttgcagaagtaaacaaacaaaacacaattatgacaccgtggaagtttcctaaatggtaacaaaaagcttaattgaaagaaagaatttccttcaacttcggtttcctggttccgctatttctcgcttgtttcttctattggacttaggatgtctcatcaatcatcttattcctgctggtgttttttgtatcgccttgccttggagtgtttatgcttgtcctttgttcagtaaccattcttcaagtttgtttcaagtagtaggataccttcagatatacgaaagaaagggagtatagttgtggatatatatatatatagcaacccttctttataagggtcctatagactatactcttcacactttaaagtacggaattaaggcccaagggaactaacaaaaacgttcaaaaagttttaaaactatatgtgttaactgtacaaaaataacttatttatcatatcatttttttctctgtttatttcttctagaacttatacctgtcttttccttttattctttgaatttggtttaatatccctttttggtttaatatccatccattcctttcacttagaactaataattcccttcgtttgataatttatcattttccttttctgttagtaaagtacccattaaatgaaactagaacgcgtaagcagcaatggctccttcaaaagaggtagagatatccagtcacttgaatctccgtgtactagaccgctgaaaaaaatgtcacctagtccatctttcacatctcttaaaatggagaagcctttcaaagatattgtaaggaagtatggaggtcatcttcatcaaagtagttacaatcccggctcaagcaaagtggagttagtaagaccagatttgtctttaaaaacagatcaaagttttcttcaaagtagtgtgcaaactacgcctaataagaaaagctgcaatgagtatctttcaactccagaggccacaccattaaaaaatacggctacagaaaatgcatgggcaacctctcgagttgtttctgcatccagtctttctatagtgacaccaacggaaattaaaaacattcttgttgatgaattctctgaattgaagttagggcaacctttgactgctcaacatcagcgaagtcatgcggtctttgaaattcctgagattgtggaaaatatcataaaaatgatagtttctctagaatctgcaaatataccaaaggaaagaccatgcttaagaagaaatccacaatcttatgagcactctctgcttatgtacaaagacgaagagagagcaaaaaaagcatggtcagcagcccagcagctacgagacccaccattagtcggacacaaggagaagaagcaaggggccttatttagttgtatgatggttaacaggttatggcttaacgtaacaaggccttttcttttcaaaagcttgcactttaagagcgtccataattttaaggagtttttacgaacttcccaggagacgacacaagtaatgagaccgtctcattttatattgcacaaattacatcaagtaacacaaccagatatagaaaggctttccagaatggagtgtcaaaatttgaaatggttagaattttacgtttgccctagaataactcccccattaagctggtttgataacctccataaacttgaaaagcttattattccaggcaataaaaacatagatgataactttttactcagactatcacagagcataccaaatttaaagcacttagttttaagagcatgtgataatgtcagtgattcaggtgttgtttgcattgctttgaattgcccgaaattaaaaacatttaacattggcagacataggcgtggaaatttaattacgagtgtctcactggtcgcgctaggcaaatacacacaggtggaaactgtggggtttgccggttgtgatgttgatgatgccggtatttgggaatttgctcgattaaatggcaaaaatgttgaaagattgtctttaaattcctgtcgtcttttgactgattactctctacccattctttttgctttaaactcatttccaaatctggctgttttagagatcagaaatttagataaaataactgatgtgaggcatttcgtgaagtacaacttgtggaaaaaatcattggatgcccccattctaatcgaagcatgtgaacgtattacgaaactaatcgatcaagaagaaaatagagttaagaggattaactccttggttgccttaaaagatatgacagcttgggttaatgcagacgacgaaatagagaataatgtggactagatggtttttgtgactttacctataaatagtacacaacagaccaccagtaattctacacacttcttaactgataatattattataattgtaactttttagcagcactaaatttaatgaatacatagatttttaactagcattttactattctgtactttttacttgaaattccagaagggccgaagaaaccagaattccttcacagaaaactattgaactacagaattctccaaaagatacactcatagtgttaagacgaatcaatgtctcggatttggaagtcctttatagagataattgtaggggccttttgtaatgtttcggatgttctgttttaagtccgcgggaggcctttttatttttcgcttttttagagatttcacgaataaaagcgttgcagaaatgcaacttcaaaagagactgaaggaaacacagatagaagaacagtcttcaaagcaatcaattcgtgtcggtgcagcttaagaaatgacttttatgcaacagcttcaagaggctggggaaagatttaggtgtatcaatggtcttttatgggttgtttttgggcttggtgtcttaaaatgtacaacgttatcacttagatttttagctcttatttttgatctttttttactaccagcagtcaatttcgacaagtatggtgctaaaactggtaaatactgtgctatcactggtgcaagtgacggtattggtaaagaatttgctagacaaatggcgaaacgtggcttcaacttggtattgatctcgagaacgcaatctaaattggaggctttacaaaaagaactagaagatcaacatcatgtcgttgtaaagattctagccattgacattgcggaggataaagaatccaactatgaatccattaaggaattgtgtgcgcagttaccaatcaccgttttggtcaataatgttggtcaatcacactccattcctgttccatttttggaaacagaagagaaggagcttagaaatattatcactatcaataacactgctacattattaattacacaaatcattgcaccaaagattgtggaaactgtgaaagctgaaaacaagaagtcgggtactcgtggtttgatcttaaccatgggctcatttggtggtctgattcccaccccacttttggctacatacagtggttcgaaatcattcttacaaggttggtctaactctttggctggggaattatctaaagatgctatcgatgttgaattaatcatttcatatttggtcactagctcgatgtctaaaatcagaagatcatctttaatgatcccaaatccacaacagtttgtaaaatccactttaagaagcgttggcagacgctgcggctctcaagaaagatacgctactatgaccccttactgggcgcacgcagtgtatcaatttgtaattacagagacctttggcgtttactctaagattgttaactccattaattattccttccataaatctatcagaattagagccttaaaaaaagccgcaagacaggttaaaaaggaatagaattatcgttctcgagatagtttttatacaatacatatatatatatatatatatatatttacaagaaaagcatggcttatgtattatacttgcttatgtaccaatatatacatatatggccttattagggcaacaaacgccaaaaataaaaacgaacctaaatgagaaaaaaagagaaaaatttggaaaacaacaagaactcaaaaaaaaaaattggtggaaggaccaagtcctcttgaaagaaaatttaatactgcttttccagaatatcatattggaaaaaatattcaagccagcacatcagctacagtggaaaatagcccagatcaaatagaactatccttcgaacatgagcggtgaattagcaaattacaaaagacttgagaaagtcggtgaaggtacatacggtgttgtttataaagcgttagacttaagacctggccaaggtcaaagagtagtcgcattgaagaaaataagactagagagtgaagacgagggtgttcccagtacagccatcagagaaatctcattattgaaggaattaaaagacgataatattgtcagattatacgatattgttcactctgatgcacacaagctatatcttgtttttgagttcctcgatttggacctgaaaagatatatggagggtattccaaaggaccaaccgttaggagctgatattgttaagaagtttatgatgcaactttgtaagggtattgcatactgccactcacaccgtattctgcatcgtgatttaaaaccgcagaacttattgattaacaaagatgggaatctaaaactaggtgattttggcttagcgcgtgcttttggtgttccgttgagagcttacacacatgaaattgttactctatggtatagagctccggaggtattactgggtggaaaacaatatagtacaggtgtcgatacatggtccatcggctgtatatttgccgaaatgtgtaacaggaaaccaatcttcagtggcgatagtgagatcgatcagattttcaagatattcagagtattgggaacgccgaatgaagctatatggccagatattgtctacttgcctgatttcaagccaagctttcctcaatggcgcagaaaagacctatcacaagtggtaccaagtctagatccacgcggtattgatttgttggacaaactcctcgcgtatgaccctattaaccggattagcgccagaagagcagccatccacccctacttccaagaatcataagcattataatctatttcgctattatattacaaatgctactgcactgtcattatagcctagtaaagtatatagtgaatacaatatactcagtttcaacattatgatgggtaactccatcagaaaatatattcatcgtcatatacggaacattcagttatacgcgaaagtaaaagtgagagcttttcaggggttaaaagctgggcgtgttccatgacgtatttaccgaggtcgtattatcaaagaaaatgaaaaaaaaaaaaaaaaaaaaaaaagcgaagaggaaaaagacaaacgaaaaacaaaacgaaataacgcattgtatgctggggcctcaattgaacttctttgactataaggagttcgcttgtttaaagccgtttcgcatctgactcgcccttggtttttttctctgttcttgtttttgacctccgcaaattcattgctctttgaattttgaagagtttcacttgtcaccgttgaataaccgagacgggtattgtttttatttccttcattatttacatcgcaacacgatttttattagcttcctcaaggagcgctgaccgtatataatataatttcaacaaccgaacaaggcagtgcgaagcggtgcaccttacaacagtgctaaagtagttacagtaaaccaattaatacgtgatgaagaaggagttgaaaattcttataatagcgaacattgcattacttatctctataatacattacacatttgatttgttgacgttatgtatagatgatacttccaaagatgcgctaacagatgaacagctgaacccccccaatggcttcaattcaacattctatgagtctcctcctcaactcataccgaaaatcattcatcaaacctacaaaacaaacgatatcccagaacagtgggtaaaagggaggcagaagtgcattgatttacatccggattacacttacattttatggacggatgaaatgtctgatactttcattaaacaggaatacccgtggtttcttgacacctttaggagttatgaatatccaattgagagggcggatgcaatacggtatttcatcctttcgcattatggtggtatttacattgacttggatgatggttgtgaaagaaggctagaccctttgttgaaagtaccagcatttctaaggaaaacttcgcctacaggagtgtcaaatgatgtgatgggctctgttccaaggcaccccttcttcttgaaggtcatcaaatcgttgaaacactataagaaaaactggtacattccatatatgacaatcatgggctctacgggccccttattcattagtgtggtttggaagcaatataagagatggtctaatacggccgaaaatggtgcggtaagaattttacaacctgcagattataaaatgcataataattcttttttctcaatatctaaaggttcctcctggcatacgggtgatgccaattttatgaaaactctagagaatcacatcttgtcttgcgtggttaccggattcatttttggctttttcatattatacggtgaatttacattttatacttggctgtgctcgggaccatttaacaacaaacgctattacattcagtggttgagtgacaagttcaagttacacaagtggaaactaacatcgtcttacaagaataaggaaaagaggcggaatcctactcgtcacgaatataattcgaggggtaagagattaagaaaagattctaatatcccctacgacagcgttttccttgatatagaaaagaatcacgcaaaatttaccgacttaacctgattgaattgccactgttctacccctataatattgtgagcatggataaatctcaaaaacaatggcgtatagatatataacaggtattaaatcttagtatttaagaattacaagtaacatgcattcctataaaaattaaagagaaaaaaattcgattataaaatagtacaatgtccagaagcttggtttttaatagtatataataaagataaagatagatagagaacataactctaaactttaagagtgaattttttttttttagtttagtttttttttttttttttttttacaataatgtattgttcttggaaaataacacaatctgttcaaagtggacagaaaccctaaaacaaaaataataacggggaaggaaaaaaatagcaagtgaaacataaatgaaaaaaaggaaaattttattggttaataagaaacgatcgactatggcaaggccgcagaagaaccggacttgctcaaccattggtcaacgacatcatcgcttaaagtagcatcaaagctttcgtcgacttcgataatgtgaatagttttatcacttgaattaaagattacggcagcctttaaagtaccatcagttggtctctcgaagtaatcttgagtaccaccatcttggccgtcatggatgtgtgagattaatttatcagaaccagcggtcaaaatttcgaacaaatccatttcaccacagccagttttccaacaagaacaagatgcatcaccatattgcaaggttcttgggatttttgcatttaataaccaaatagctggcatatcttgattgtaggcagaaccgctggtgtcacttggcatagaaaattcgaagacgaaaattttatcagccccaccaaacccatgataagcaggaatgccttctctgtaataaccacaatcgccgttattaccggaacattcttcaccggagaaaatcatgaattcattaccagatttaatggtgacatcaccaagagcttgagcggaggcagcaccagaaacaccatctgaagcagcaaaagagatggagttaccgaaacaactcgaccagacaccagaaccggcagtccccccttggttgttcatgaatgtacagttgctagtagagcctgggacaaagtaggaacctctggaccagtcaccgttagtgttagaagatgatgacgaagatgatgaagcagcagcagcagaagaggtggttttagaggaagagatggaagactggctttcactcgtttcaactgcttgagcactgctggacaaaacagtagagtctttagtgtaagaagaaggaacagcaggaccgacaacggtattggtggaatcggctgtgactgtttgaccattactgtcgacgtaaacagtggaagtaacttgaacatattcaacagcaacatccctcttgtgctgatgcttatgtctggagacaacagcttcaccttccttacaggactcgattgattgtttctctgatcttttcttcaaagcattagattcaccatttgggtagtaaacaccaaattgtagtaactcgatcggacccctgaaatgaacagatagttcctcgttgaagggagccaagctaccagaagcagtgaaatcagcttgggtacaagcacaagaagattcatccatattggtgacatcttggtaggtagcagataaaccgacgttagagtaaatgatggcatcggtttgagcacaatagtaattaccgccagagtaagtacaatcagcgttcacgagtgacacaactgaagaaaacaaaccgactaatgcggtcatggaaagcttttgtaacatttttttcgttcaaattccgttaggttttagatattttatggggtgtaaatggaaaaacgaaaaggtgagaaaaagacgttctattgaaggagtgactagaagttggataagttaggttggtttgagttttgattctggagtcttcttgcgagaaaagaaataattataatataaaaaaaaattgaatggagataagaagtttaactagcaaagttcgagagatataaaaagtagagatgcgaaaataaaattaaaacaaatctgaaaataatggaagtgaaacaaggctaagcaagaaaattttctatattgccaagacaggaacgtttgtgatgaatcacatctgcattcgtggtatatttaaatgaaaatcccaagtttcgaattttcacgtttgctgtacgacgaaaaagcgtggaaaaataaacaaaaccagcactaaatcgccaacgaaaaaggaaagtcgccaacgcgaaaagaaaagaaaaagcgaggcgcagatctcgtggtatgtgatatcgtgtctaatgacttgacgtggctttttttcttgtcgccatctgcgcttacttgcgttatatcaaatataatttcagcacagcattacatgcagaaatagcagggtgcagaggtcgaagtagatagaggacaacacctgcgatggccgtacagacaccaagacaaagactggctaatgccaagtttaacaagaataacgaaaagtatagaaaatacggtaagaagaaggagggcaaaactgagaaaaccgcacctgtgatatccaaaacttggttgggtattcttctgtttcttctcgtaggtggtggtgttttgcaactaatcagctatatcctatgaagcagtggcaaattgcatatataagtgtacagtggaagcaagtacgtaaataaataagcgatttcgaataataataacaacaagcataaggcagtattacccgcgttgtcatttatggatgcgaaaaaagatgaagtaattcaagtgctattgtgatttaccatgccaatcaaacgtgcaacaaagatgagtatgaggggggacccaggcatagtacacagaaaagctttgtagactgtctttgttttcttaatttttcaagtaggctttctgcttttcttctgtacttatcgtatgctgggccgggcactaatcaacaagtatggatttttaattcatcctaggagatttgtacatttaaacgataagtcccttgatggaacatttatactaccttcgaagaaaaatcatatgtatgatgttccaactaatgatccaagcggtatcctgaatgcctcggatatcgatagaatcaataatttgccatttttcgataacaccagtccgacaaaagagacaaatactaaggaaggagcattgttgagcgaaaaattggccagcgttaaagaattatttggagaagaccctgaaaatccttcgtttatcaattacagattccccagaggtttagagaatccctattttgacattcaagtaaatcagctaaagaaaaaacgattatccgtcacacaattatgcactacgcagaattggtgcgagttaaggaatttttacgacttttattctcaaaatttgtctaaccaactactgaacttaaaatttcaggtgcagaaaggtaaaaagattcataaatcactagaggacgaaacgcatcctgaattaaatcagtataaaagctttacccacaatttccttgcactgacaaaattatctatggatattgataatgatatggatgccctgctagataactggttcaactctatcaatagattggtctctttattcaccaaaggtgacggtcatgcaagagaaatagtttgtcatggcttcattaacttagaagatggcaaactggtggagcatttgctgaacagtgatagcaagacaaaggaaaatgtgattatatcaggtgttattgaccacttaactcttagaaataggcacaatcatcaagtacagaaaggtgcagctcatcttgatacggaatatcagagctggggtaatatcctcactaatttactatcaaatctaaaagaactgaagtcgaataacgagattgttatctctgatatcaaaactaggtcagtaccaaaaataccatctattgagtccgttatagaatcctctaaattacagacaatgtattataagttttttttttcccaccttagtcaagacatgacacaaacctaccatagctttttaatcaatgcccagagaagaggactcgacgttgatgcgcccataaatcctaccaagattttaacattcatactaacaaacccactcttcgctaatgatgtgaagaacctcctgtacggactaccgataaatcattctgctttcgataacgacgccaaaggctctaatacatttgatatgaccgcgttcaatgatttgctggatagaggtcccacatcttttaacgttccgattgagcaagacgaagatagttcggagtcaacaaaatgtgtatctttgcgagattatggacatttttatacgaaatggaagacacctctaactttgaaatactttgcggcaaggttatcacagatctattttattgtgggtaatctcgtttcgaatgatttaatgatagaatattattaccataacgataatttccacaatatcatcttcccatatgatcccttgaaactgggaacccatgcccatgattctgcaatggtttggtttggtggcagagatatgcatccaattgagcctactcaaaaaaacttcaacacatactgtaagttttgtgactacagacacgtttgttcttggaaaaataaaaatgaattgaaacttattgatctagggaaagaattaaaaaaaattattcttgaatcaagtatgaagtagtgtaggtattgtaacattatttattctagttattaaaagggtgttgtttcgtgaatacattgaagtcctttattgggttattaagcacataaatctgtttctgctttcggacgtcctgtttcaataaatcggaattgaaatgacaatttaatttaaatgtatatatgcaactttcattaagaggtcattaggtattttaatgcggccttctcattcatcggaacgatgtaattgcctttagaattaaaacccaaagagaaacatgtatacacttactaactctattatgtttggatagagctccttgataattcagttacaaaacaaattatatgtatattcaatgccatttaaaaagtatgcatctacactttttttttgcaaatctttatcgctataactgttcctcttttataacatcaatcaaccaatctaaaccttcggtaataccttcgcctttaattgcactggatgctacgatagaccaacttctgtccttcaattctacaagattcagttctttggagacttcactggcacttaatgcacccggttggtcttgtttatttgcaaaaaccagcagtgctgcatcttgcaattcttcttcctgtaacatcaaatgaagttccttagaggctgtagacatacgatctttatcagtcgaatcaacaacgaaaataactgcagcagtgtctgcataataacacctccagtagggcctgatacttgtttgaccaccaagatcccagacgttcaattttaagtttttataacttagcgtctctacattgaaaccaatggttggctttgtagtgactacttcgccaatttgtaaacgatataagatggtagttttacctgcaccatccaaacccaaaatcaatatacgcaattctttgtttgaaccccatagtttgtcaaacattgaactaaaaatgttacccatcttgatctataactcactttactggaactttcttcttagatctttctttatttttcctttggttttagaaaccttattactcaccgtttcgtaaatacaaatgaaccacgcaatcctttactacttgaaagttccgagaacattctgcctaatattaattgtcgtaaatctaacttttataggcaaaatagttttattcaaaatttcaattggaaagggctctgttacccgtcctgtacgatgcagtgggttttgttattgtcataagaaatatttaacctactcttcccatatatatcatagaacacattcttagtatgttttgagagcatcaatctaacgttgcctttgtcgtgattttgtgcgaggaggcgatataagagctaaacagatttttttatattttaatcaaaaagctaataattatggcttactctttaacaaggaaattgctgaaggattggaaatattttatgcgccatcctgagaagacccaaggtctttttcatgtaaggccacatgattcagacttacatctttggcacgtggtaatgtacgagcccaggacttctttggaagtatatctactactttatattggcggaaacgaccaggatccatatatcatcatgaaatgtctgtctccaaattgttgctttccaattaacagaacggtttcgatgacacacttaaactatcttttattgaaagacttgggattacaggatttacttttccacatatggcaaccgctttttcatattcaagcaacggaagacttacagtattcaccgtcaacggtaaaattcaacagggcgtggaataggattatatataaggactttaaatcttattttccggaactgataggtactttacaaccaggtgattactctatagtaaagagctattccaaaaatcataatatcagcaatagtaatggtggcagtgtcaatgaatttatgtcctcttacaatgctcaaagccacacctttcacgcacaagacaacagcaagaacccttatactaacagcagcataggaaagtctagtatgttatctactctcaacaataataacgttaacaaaaggacacatgactacaatgctatcgactttatgaccaaaaacttacttgcatgtgatgatgacagtattcatccggtcgtaagttctaaaaggtcaagaacgttggcatgtccagatgaaacgaacgataatcgcggtagtgagcattacacaaagaggaaaaaaatctaatgggtttatttttacatagaatagtagaactttcttccttttttcacgattttttgcatgggcatttgtcacaatatatatttttattcagttatataaatatactccttttcacaaaagaaggcctaatattataggaaatcagcattaaaaacattatgtatttcttttttcagcggccgaacggtcactagaatgactcagaatggtttttatcatctcgttgccaatgagattagcctctggaagcattggctcaaagaacttttgaacactctgaaattgctttttgtatatatcaaaattggcaaaagaaacaaccgagctccattctctagccgaaataacaaattctaaatcatcttttatgaatgatttatcatggatagctgcatcaattgtctgttctaataagccaggttttaaaaaaagatattcggacacacccaggaatattctgaataatggcgtcgaacaaatcatatgatcatatggatcaataccaagttgaaaccacgaatcaacaatcgccaacaatgataaatgtgaattcggcactggcttgcaattgttgctgttaccaatgctgctttttgatagcgaatatttctctaaaatcgtgtcatccaatagtaagagaccagtatgctttccaaatacaaattgcttagcttttaatagtctatcagtaagttcttgttctttgttatctatcattaaactaaatagttctgttgcactggttgcatattgaagaatttgctgatgtgcacttgggtttgttatggctaatcctgcgtaaacatgccacttgttcgaatagattcttagtgatatattaactttcacattttctaggccaccgtaccatttgtttacacccagagtccaaggataaatctttatctttgcccacgcagatcccatacttaagaaagcagcatgtgtcacagcttgtgtatcagcggtaatcttgtcatgctcttcatatgtcaaataaacttgcttacttttcaaacatgccataacagaattaacgaactcaaaagattctgggtactgtgatctgtgattgataataactagtggttggccttcagtattaactttaggcccatgaagggaatgcacggtaatgatgtcgcagtccttgggtaaatacttttcgaaagcctcgatttccggcagcttacaactcgtttgacccccaacaattgttccaaccttagaagatggtccatacgttgcgacgatcttactaatattggatgcttcaacactatagataatatagtcgctttgcctggataccaaatgaccatttttcaccagttcgaatttagctgaggcatatttttctttcagttcatcataatattcttccctatcacaacatataacaccccatccagcatctgtaaatttattagcgtataataggcccatatcacccagaccaattataccaatgacttttgtggctttccattgctcaatcttatcctctgataccatgtttatcaagtggatatgctgtcctctttccttcaagtgctacggtattcttgtaattctaaaaacttttcttggtttgaataattccagtatcactttcttcaaagcttattttcatataaggcctcaaaaaaaaaaaaaaaaaatgacacatagctgaagtgataaacttactacactggtataacgcttattagaggaaatctaataataaactgttagctataaatagtatacaataacaatgagcgctaaaagtatgacatattaaacataaatacgcaattctacaccgcttacagcccttttctttagttgggtttctttatcgtcatcttcaacatcactttccatgtcgatatcagcttggccttcagttattacttcatcaagaacttctatagttttagtgtaaacctctattttcttgttcttctgatcttgaaaatgacaacctaatgccagtgtcttttctacagctttacccatacccaaaaccgcaacataggatgatccttgcttatgaacgctatcgagaaacttatttattcttttcagtgcactaacgtatggtgttgtagacttaacgaaaattgttgtgtgtatttgcttatgcgttagagttttcaaagatgggtgtttcgttactcgtttggtagatttgttgtgtgtattctttttgagtgccatcctgggtgcagagttctcttttcttctttgaccgtcaatcttattgcttatttctgaatagttaagtagctctttacagagagtgaaattaaacaaatggtcaaacaatcgcaggaaaaaaatgaagaaaaaacattttttcgaaatgacatgagaagactattgatgtacttctcatgattattcaaccatattgagctggacagatttttaccaaattgatttgggaattttagacattattgttgtcataccattttcatattcaattcaacagcctggtggggaagtaaagaaattatccccgaaacaaatacccttttatgcttatttccaagaattactggaacaccaactgcaagggtaaacagaattgatgaagaaggtgcaatcactcgaaactacttcatactttctcttttctttcattgatcttaatttagttcagtggacatcattttgctaatttcaaggaaagaaatggacacaaattctaaaaccaaagtacaaactgaaaataaaaaaattaaggcgaaatttatacataatcatgggcaaaagccctctcttatccaaattacacctccaatgatttccagcactctgtttcacgcatatccactactactaatattcgacaatgccttagcgaatataatgtggctgtccgacgataaatgtttaacattcatttatctaacgagcatatggctgaccataagtttttttatccccgttgaaacagaggctagccattttctgccatttacaaagattttgagactatggttaggcattataagcggggcatttctattcttatcattcatgtattatattgtttcattgatagcttcgttaagagacacggaacctcctacattggatgaaattgtcgtgctactagagtctgtgttggataaactggaagtactgagaaacgagctgaatgtttggaaaaaattaaagctttcatttgatggcgtcaataaggagtgttctggcaagaggttgttttgcagattattcttattcggtacaatttttcaaattattatcatgagatacatatcaccgggaacttatactagattttttattattaccggcttgatatacaatacgagtagttttcaagctaccttaaggctactttggaggtttactgctgttaggaatttctattatttggggattgaaagttttaaaatttcgagtttcttaccaaaacacttaaagatggaacaaattattcctttatctcaaggacgtgcaatcacggtgccactggtagaggtattgcctaaactacttcgggacaagaagggtgatgaccacattcatattctacagcttctacttaatgagcaaaaagataactttggtaatgaagaccttaaaatactagaaattgaagtatacgaaaatcaaagaaggtggtatcaaaataaaaattggagtacaaaattactgccgtacgaaagacaaaactactgcatagaaattaaaaacactgatggaactttaaccatgaggagttgtttgcccccagatggacttggtgaagaagaattacccaataattggcattggatcaatgataattgggacggaactgattggatatattcagattcagcatggaaagaaattggacaatacagttctttggaaagttttaccaggtcaagaaaatggaaacgacgcctcttccatttgtaatagtattgctttaagcctctaaactgcatatatagttggttgcctaacattatcatgatatgaagaattttctcatactttgaaacataggacaagtaaaactttataagatcatgtgcactttgtgtatgttatttcataattttcattaaattcttataacggcttatgtagaaataattatcatttttataatagaagattgaatatagaggtaatgtataaagggcacataatgaagcactagtggttcatttaagaaagaataaagagggaacaatccaaatagacaaaaattccgattaatcaaggtccatgttttcatcattgttgtcatcgctatcatcacttgcagcgcgtgcccttctttgctcagccaatttttcagcaatatcattcattttagaagtttcttgattcgctctgagtgcttgtcttttttcttcctcctttgctaaatatctacctctaataatattccccaacgatgccagctcctcatatttagcaatgtattttgccttggtagaatcgtcaccatcaccatataaccaattttcagtagtggctaacatgttttttagcttttctttttctgcgtcagacgcaaaatcggagtattcatcatcgagtttggcacgaagggtataaatatactcttcaagggcatttttgcgatcctcggtttcggcaactaacttatcctggtttcttaattcattctctttttcaattagatcgttcaactcaaccgggtttagcgcgaatgtttttgcagtcatacctagcacatctttcttaattgttttagtaacttctttaaactggggctcggcatcttctggtgcgtcttccggtaaaggcactggctcttgaaccgtaatatcttccgttgtgtaagcgttctcgataatatgcaagccggaaggatcgcatcttaacttgacctttacaggaataaaatcttgatctttaggaaccttgaccccagtgaagctccattttgcaatagtggtggaagtaccttttggcagtttcgaaggatgagtgtacaccgctttcatgctgaaatctccagtacgatgtaaagtaattagtttagttgatggatatgatgaattagcagggaatacttccaaacggtcttcgtcatcgacctgcttatcccaagtgtatgacactgaatacggatcaatatcttcaaatttaaacggcctgacccttaaagttggagagtgaatggcacatatgaaagcggcccccttggccacagcttcgtcttgatttaaagtagatgacaaaggttttccaaaaacatcagaaattgacttctttaaaactgggatacgggttgtaccaccaattatttctacgaagtcaatatcattgacagttaatttagcttgagccaatgcattggtgattggatacgtcacacgcttcaacaagggctctactaattcttccagctcttcacggctcaattgagaggaaacgtcgatatcatccataacagattcaacggagaagggggcagtagtgttcgcagaaagcactttttttaatttttcagcagcgattaaaattctgttataagctttcggatttttcctaatgtcaatcttgtacttgtccttaaactgatcagcaaaatgttctgtgattgcgcgatcgaaatctctaccaccaaagtgcttgtcataagcagtacctaatactttcatttcgcctttgcggaaagccataatagaacaggtgtaggtagaatgcccaatgtccactaagccaatgattcttggcttttcttcaggacctggcagatcattcttgaagacgccgtacgaaacggcggctgcagtcacatcgttgacaatccttacaggatttaatcctgcaattctggcagcatcggctatgttataacgttgttcttccgaataccatacaggaactgcgaggcagacatcggtaattgatgacttcgtttcctcttgaacggtgtgcttcaccttatcaatgaacatagcagtcagttgagtagctgaaaatacgtgtgttttaccgccgaactccacttccacaccaactttaccattttttagctgtaccaatttcgaagtgaagaacttattctcgatatcaaattcagggtctttgaactttagtccaatgattcttttcaagttttccacagtgtttttaacattcgatgtttgcttagttttaccagattcacctaagtacctatttctggggccaaagccgaccaaggatggtgtagacctattagaaacttcattgacaacgacatcaatacccctatttctggcaactgctagtactgagttattgttacctaaatctaagccaaatggagtgctcattatattatatcctttggttacgtctgttacaggtaaaaaaaaaaaaaaaaggaagttttaagggatatttccaaaatctatatacaagatttcataaataaaaatctctaaacggcaaagtcctttggtttatatcaagagtaccttaatatataccaatttgtaaaagcgactcccagttattgttccttaaaactcctcgtatgatgtgatttttggtaaggggacgttctagaaacgtctactattttggatgatttacatagttttaaaataaaaaaggctcaattttaccttccgcgcatttctatttttttaatctaaaacctcaaatcttacagtctctcctagccgctttcctgaaggatcatgactaacgtttgccaaccagccgatgagacaagttttagtagagattcttcccattcatttttcacagcagattctattagtaacttccattcgtctggagagagtatctgcagagaatttatgtataatagtaaatgaaagttcgagattttttcatgcaaaagattgaaatctccacttgaagccacattgaataaatacttttttaattcttgataatcttgagattgccccatagcttgtcgattgctccatggaaatccggtggaactaacgaatttcgagttggtttccgtatcggtattcgggaacccatgagtcagcgtcactaaaagatagtctaccggaaatgcaggcttcgcattttccttcactgttataccatattcattcgacttcatgtaaaatatctcaggtacatatctttcatctgtagtgtcattaatatatgccattgaaggaaatgtggacccacttatcatatctgcagtaaccaatgcttcagcttctgtggatacttggtagctcgaaatatcaatttcaccttccaaattacctgatataacgcaagttacaaacttggaagaaaaaaaaccttgttcgctatacttgcttacattaggatgccttgtttgatgcctagcagccataataacttctaatgatgaaagaaaaaacgaatccttatgtcttttgcaaaaaacagacccatccccagctcccgcgtcagataaatctgtaaatattaggccaattcgcgaaagccccatttcttgagcctgtctatcaatctgtagcatttcattcttgacctgttctacgtccatggttaaaccgtcttgctcatcatgctgagggggctcgtatatcgcctcaacgacggcctttatacctaaaggtgtgttatcatacttagaataagatccgtacatatagccaaatctttgcatacccgtgtacctccacgcctgaataaattcattaattatttcactcttctgaaattcaacgtggtcaaccattctaaattcttgctgttgtaatgtaattgccgatggttgacatttagaacatatcccccgaggccatggttcatggccattatggcaacgcttattgattctaaaatcaggttctgaaagaggggaaatataagagctgccgttctccttcttattagcattttcatttagctttttaagatatgaatgaaacgatatatgtttgatcttattcttctcatgatattctttgtcccaaggaggtaaaggcgagcagtattcacacatacctctatcaccgtgcttgcatagttttgatttttgacgaggaattaatccgtcctctttctctagttcctcatctacagcgagttctttgatccttagtggaccgtacctgtgttgacgaattcccttgctgtcaatacctacggatccgatttcaacattgacaccatctttctcattagcgggcttgtccgaatagttaaggatcagcatgtcaccgtgctttagtcctagatccatcactgttcgatcagctagttcagaaacagcatgaataccttgaccgggcttctcacaaacagtaaatgtgtcgacatcggcattggggtccagattacccaccaacttttcaatgaccgttccgaaaaggtcgttttcttgacaagaaaccctgtgtgtaccgttttttgatctaaatctgataagcatacttcacttaaatgtatatcgatatcagtagtatagggaaatttttcttcagagtactgtcctattatttgccactcttcgttctgtatgttacgagggcgttccttaaaatgggtagacgcatcttattacccgccaaaaaacgtcaaaagttttaggaacacgtctaaaagttgaaataatatgtgaaaaaattgatgaaatattaatgaaatggcttatttaaacgaattcaagtacaggaaagaggtacgcacaactacttgagtttgccaatatgtccgaatttaatgaaacaaaattctccaacaacgggacgttttttgaaacggaagagccaattgtggagacgaaatcaatctccgtttataccccactcatatatgtctttattctggtggtgtcccttgtgatgtttgcttcaagctacagaaagaagcaggccaaaaaaattagtgagcaaccatccatatttgacgaaaacgatgcccatgatctgtatttccaaataaaggaaatgagtgaaaatgaaaaaattcacgagaaggtgttgaaggccgctttattgaacagaggagcagaatctgttagacgatcattaaagttaaaagagttggctcctcagataaaccttctatataaaaatggctctattggggaggattactggaagagatttgaaactgaagttaaattaattgaattggaatttaaagatactttacaagaagctgaaagattgcaaccgggctgggttcaattgttcgttatggtttgtaaagaaatttgctttaatcaagctctctctagacgttatcaatcaatcttgaaacggaaagaagtgtgtattaaagagtgggagctgaaaataaataatgatggaagattagtcaattagtgcctactgtgtgcaaagatatgtattcgctcgttcagtgtttttttaaaaatatgtatagaatttgtcattatctgcgttaaaaaatagttataaagtatatacaataacaataaatgataaagaaatatgcagtgaaaagaaaaaattatgaagcttttcctttcagtgttttctacccttcttcttgctcactacttggaattcccagccgtcgtcatcattgcctgatagagctagcgcttcattccaacttagtggatcatcaccttgtttttcgcacgcaacacgtcttttaataaattcagtggcaaatcttctaccatccataacgtcactattggcataaattgtttcttgaatcaattctttagattctggccccgtaggtaaactcaataatagttctaagacattgttattggttattccagaatttaatttcatctgtgatttacaccatttgataaattcttgccggggagaaacattgttcatgctagcaaaggtagtggtagtagaagttgtgctagtttttgccgttaatgaagaatttaaactggtattggtttttgaatatggggagacaacggttcctataggtgctttccctttagaagtcaccgtagtccaagaagatgtggtagtagatgcagaggatgtggactttacttgtttggaagaactctgaaccttttcccatagttttttctgctcttctatgaaatttggatcttccaactcctttaacggagacgactctttcatcccttttgggcttttttgaaactgagatttaatatcaatagtttgattcgatggtaggctggacttgttagcccagttaagcacggattttagttcctccttttgcttttcttctttgctgttcctctgttgtagacctaagggttctcctttcttctttccagtgctacttacaccatttttaattgaagtttcgattgcattgttaactttgacttttgaggcccatggtgccggattcgcgcttgaggaatttaatgaaggcaaatcttttgatgtcttaaagccttctgtttgtgtttgtgtgtccttttttgtcttttctgattttttttgcttttctgcttccaaagcttctttttccttttgttccttttgttccttttgtttcttcaataaatcatcctctttttgcttttgtttcttcgataagcgagcttcttccttccttttgagttctctgttccgtttctcttgttcatccaataacgcttttgctacagattcggatttttccttcttccctttttccagcatagtggtcgatttgtattcttgcttgtgagattcatctgtttgactaatggtggttgctgaggctaatttaatatcgactcccttggaggtggtacctccatccatatcccagatattgtcatgtgtcaatggcttgaaaatatcgttttcagtagctttaatagtgccagtagcggcaacaccgcttgcgtaaggagctagattcaagttgatagaatcagagctggttgtttgaacgtgaagtttgtcaaaagtagtgaatggatccgtatcatacttctcgagtttagtcattaactcaccaagtgtgatgaaaatatcgtttattcctagcgtttctggagtgcttcccaatcttgaaatctgaagggttgaagcaaaatagccacctatgtaccattgtgacatcatttgggtagtaaatggaccatgaatctgtccctgcgtgtctatgtacctccaactggattcaactgaaactggtgctgggagttgtgacattccgttcatgctcatattaggaggaatatcagaggacggaaacaaattgacatgagattgggcagcagttggtgtacttaatggagtaatatctaccgccaatgaatgtgtactcagattcactccaagattagcagcataactaaaggaggaggaggactcgtttctttgcaatagtggatgctgctgaacaggcgtactaacccgtgattcaggatggtcgccgtgccaaaaagaggaactcattactcccgaactttgaggaataaaaggctctttcatagaagaaaatggtgacgcagcacgctgtataccaatagaatcgattaaggaagacgtcctactgagtggatgtcgacctcctaaaagaggtgtattggatctaaacgtcgatccagggactgtattcacgcttgcagcaacagcaccgtttgtattgttattaacgctcgcaggggaggaatccaggatagtagaaacaccgtgtgtgttattgttttctgtatcgactgaatctagttttaagtccttaaactgttcatcaaaggaaccgaataatctttgcgagtctggtgctatcattattgatgtgggctgagaagttgagtatataggggaggaggaaggaaggtaaaagctcaaggagtacgaatggaaatgatgaactcgaagagaccactgaactgcgtgtgtgggtatttgtagtattgtgaaaagttccaaaaggcccatcaaatcaaatcaacctataagtggaaatatgaaaaatttttttttttttcagtgcgactgaaaaaaaggcatagggtaattgcggactatataggacactaaaaatatagtgtggcacaactatgtagtataagtattacggcactaatctaatcttttcaatggtttacgtgacagatgtataaagaaattgagagcaatttttaaatgcctaattgtttttcgattttgctgtggacgtcatcacctaccatggtgctggcttgtaggccagtaccagggtagacgtcctcccaatcgatgctgcactctttgttcagtagtatgtcacggtgtatactaccgtttgttgaaagggggttgaagtcggtacgattgacgatttccatttccatcgtccttttcattggttcggcaatgccaaatatttgtcgatactgttccatttgtctttggcgctgtgtggtttcccagttcttcaatgttgattctaatggatgtctgtcattcaattgtgtggaaagaggtactgcaccgccttcttgctggcgtaatgtgtctggcaaggagggcactgcagatgaaagaacacttttgtcttgatctgtagagacttgagatttaaaggtatcttgtgggacgatattcatagttggtatgcaggctgtttctggtcttgtctatttaatactcattccctctccagtgagcaggaaactacataatatactttaataacctcaggtaggataaaattgccactgcatggttacccgaggagtgaaaaaagcaagaccataagaaatgcttgtgcatcactggcggtagatattggaaagtttgagcgtaggctcattcatttgcaagtggccattatatgctaacatgttccagtttgttactcctgtgggaacacagaatggattgaaagctacttgtgcgaaaatatctcctgatgggcagtttcttgctataacacaaggacttaacatcctgatatacgacattaacagacgaactgtatcacaaacactagtcacatcacatgccaggcctttctcagagttatgctggtctccagatggacagtgcatagctactgcatcggatgatttttctgtggaaatcattcatttatcttatgggctgctgcacacttttatcggccatacagcgccagtgatatctctgacattcaatagaaaggggaacttgctgtttacatcctcaatggacgaaagtatcaaaatatgggacacactgaacgggtctttgatgaaaacaatatctgcacactcagaagcagttgtgtcggtggacgtacccatgaatgattcatccattctgagttcaggttcatatgacgggctcatacggatctttgatgcagagacgggccattgtttgaagacattgacctatgacaaggattggaaaagagaaaatggtgtggtacccatctcccaagttaagttttctgagaatgcaagatatctcctggtgaaatcgctggacggtgtagtgaaaatatgggattgcatcgggggttgtgtagttcgtactttccaggttcagcctcttgaaaagggcgtactgcatcattcctgcggtatggacttcttaaatcctgaagatggatccactcctttggtgatcagcggttatgaaaatggcgatatatattgttggaattctgatacaaaaagcctcttacagttgctcgatggttctttatatcaccacagcagccctgtaatgagcatacattgcttcggtaatataatgtgttcccttgcattgaatggagattgctgtttatggagatgggtttaaagaatctgcgttatgtacacgacagacattcccttaaggtgtaacacaagagtatatatagatatattatagacgtttaaaagttttaagggatcggattttcagccagatattttttactttattctaatttttttttttatttttcactgctgctgtcttgcgtgatgagtaagatatcctaaaaaactactaagggaagttcgggcagctttcaacattaagtgttcacatctcgaagaactcgcgccttaaaccagcctatacaaaagcttagtacagattacctactgcattgatagctagcatctgtcttgttaataaattagcttgccataaaattagggaaatttttactcacaatatgaatataatgaaaagacaattatgcacctcctctaagcgatttttttctacagcaaaaaacgttgtcaaatataatacgattcaggatatcaggaacaaatattttactggtacgcctttgtcgatgtgtactgcgtatgacttcattactgcaacatgggttaacaaggctaattgtgatttactcttagtcggagattctttggcgatgacttcattggggtacgatagcacaattacactatccttgaatgagtttaaatatcatgttgcctctgtgtgcagagctgaaggttcttccatggtagtggtagacatgccattcggtacgtttgaatcgggcatatctgatggcttgaagaatgccatagatatcatgaaattggacagtaaagtcacctcagtcaaagttgaagtcggttcttacaccaaagacaaatatgcaatgaaatttattgaagaactgtgctcccggggtatacctgttatggctcatataggactaactccccaaaaagttcattcacttggaggttataaagtgcaaggtagcaaaagtctattacaaatgcaggagctgtatgaaaccgccatgcaactacaaaaaattggctgttggtctatcctgattgaatgtgtcccccataagatggctcagttcataacatctaaactctcagtaccaacaataggtatcggtgcaggtaacggtaccagtggacaagttctagttatatctgaccttctcgggatgcaaggcgattctgtcccaaaatttgtgaagcaagctgtaaatatgacagatattgccactcagggcttgaaggagtacattgcaagtgtagaggataggacatttcctgagagaggtactcatactttcaaagttaaggaggacttatggaatgaattcctctcttcaattaacgaaaagtaaaatatatagataaaaatcactgcatagggaaaaaaactttaaattttaggtatactgaagacaacaaaaaatacataacttaaaataaaggggcattgatccaatgttgtataaatacataggaaagtggtttgaaaattgtgtgacatcatacgactaattcatcaaacttagtgaaaaattctgcaattgccttggtagcccacgagttgttgtctttatctaggtaagctaaatgaccacctaaatcggttctacaatacaaaatacgaggattcttttccacgattgagtatggttgatctgggccgacaacaggatcatccctggaattgataacaagggtaggaacccgaattgtatcaactctgtttattgagctggccgctttataatactccatagcatttgggaagcctaaagcaggcgcagtgtacacttcatcaaattcccgggtcgatttaaagctctttgcctttattagattttcaggcgtgaacatatagaaagatggattcttgactgtgggaggatgatcggggagagagccatttggaactcctaattcacccatattaacctgaacggttcttgttaagaattgcgcaatatttttggaaaataaagttcttgaccaccaatcctggctcatcctaattgctgaaaggagaagatcccaaggattgcacaaagtagcagctgcggataaaggtgatttatcgccctcttctcccagatagtttgccagcatcgtagcaccaaaagagcatcccacagcgtatagttttctatctggatgtctttgcttttctctttgcaaaaactcgcgaatatccattgtgtgataagctgtaaataaatttctggtggtaattttggaacgtgcacaacctctggtatttaggacgaccacttgaaatctcccactgcgagacaggttttcagcaagagatcttataatcggctcatgactaccaccagcaagaccatgtagaataactactaggggtagatcaacctcccgtagttcttccaactcattatctttcaggtaccttgtacgtggttgtaaacgaggccatccttctggatgtgtcgccttctcgtctttatcaaatttttttttatcaaagctcgtagtactttgatcgaattcataatcctttttccatgaatctatgagccagtcagcggtgcaaactccaccatccgagaatttgacaatttccctgccgtagaatacaggaaatttcttagagaaatcagcagcacctaagtacaaagtttgcaaaatacctgtgaacaagtaaggactcaatttgaattgggcaccattcttcaacgttgggacatatttgttagcgaactcgtcaaaatcaacttgctccttgttgtcttttaaatggagtttaatggaaccattttcaccgacaatatgcgaaactgtaccattgtatccccaatggaatgggttgattgctggccatttggaaacttctgacatatcggaaacttttatgagctttgttttttacgcaactactatcaatgtaataatagaacttaaaaaactgctcatattaataataaacggaggaaatactcgaggagctattacttccagggacatccgatatctgacgccttttaaaatctgcacatgcgcaagatttaaaaaaaaaaaaggatctcggaaccggaacgagattgctcatttttcgttccgtttccgcaggttttgcaaatcattaagcagatacacaagggtccttttaatgtttatgtaatttcgtgcaaagtgaaaaaaaaaatggacctgcttggaataaaataataagtaacattatgtatattgatttgaaaagacctcatatatttacaagaatatctaatcgatgtctaaatttatttcttccaccatcaatttttgagccacggttccttcgtatagagattggaagaatttgattgacaacaagttactttcttttttgttttccaattctttcttagtgatttgttttttatccataattatttcacacgaccttagaatttcacgtgtaggtacacgcaaaacatcacgtacttcatttgaggttctttgagcgttaagatgaatgtaatccagttcttgcaactttcttttgtatttaatggaaagattcattggtaaggcacgggggaggtcatgaattaaatacgtaagtcccaacaaggaacctaccactataaccggaactgataacttcttgagtgagctccacgacgataatttaatgccgtttaatataatgttccccacaacctttgtacttcctagaaagtacagcgttagagtgggaatttttgatgtgaagagcaatgatggtcttgaccaatattgtgtcaaaggataatttttcaaacccaaatacttcattaggccaatctgaccctcgttagtttgtccttctatatccggcagtggtgctgtgacaggtttctgccagcttaagtaagacaaaaagcctttccaagttggagcaaacaaatcagttattgacaaagatactttaagcctttttcctatcaaatgcttcctttttctaaacattagttcgcttctgaaaacacgttcacacatgaaatcatcaccaagttcattttttccaatctcataaattttttttaccagtaaatctgtcttttgcttggcaaataattcacttgatcctattgactcatcaatctgatttgctatgaacgcttctgttgaaaatatgaagtcataaatttgaccgaggccctgatatttcggatattcgtgtagcggaacatccaacgcattgagaagtgcttctttagtattgttataagtcattgtaattgtttgctcggccatttgatcaacggaagttgttaaatcattgcactttgctctagcgctcaaaatttcaggtctcaatgtttccagttgttcgttaatttttatttcttcttcactatacattttcatattagatttggagatcattattatatcgcttaataatttcgatagataagtcttggcaggtaacaatttagaaagtgatcttttcttcaaaacaaaattgcgtagagaatcttccagactgtcaaaatccggatcgggatcgctgctagaatatgggtcgtcgtcaggttttcggtcaccatgatcttcattgtcattttcattatgataatgtggcaattcatctccgtttttggaaacaaagtggacaaaatcagctgcacgtttatatgtttctggggacaggtcacggatttgctttaggatcaactccttacaacgttgtttgtccctgattttgtcaaattttttcacaacaaaaaacattaattttttctcacgagatgctaaagaaataaactccttggcagatagtgttagctggttctctgcattgacaacaaatataactaagtcgatttcttcttgtcgggacattacttcggcggtttgtaacgagtccatgttcaacccaggggagtcaattaatgaaatatcaacagtaccattccttaatagactagtagaggcaggccttttatcgtcctttatgtaaatcttcagtaaagcatattttccgttttggggaaccaaatcgggaagttctttcaaagtgtgtatttcataagtcttgggattttgtattgaatacatatcaatggcttccttgagagtcggagcaatgtttagtggtatggcatgaacctcctctatgccgtcattttcccgagcctctagtatttcggaaaatacattggtacatggtagctgatcctcaggtagcaaacgctgctttaatagagagttgcaaagagctgatttaccagtatttacatcacctgtgatgaatactttagatgaaacgtcatccactctttttttcaaagcgtttaaatgatttgtcactgatacgatctgagagtgaaataattttgataaagcttttttctcaatgttgaaaccgttcttttctttggtattgtactgaccatctagcttgatattcagttgtagaacatgtaatttttcccgttcatcatttgcagcaataaaaatcgggcgaatattattttcttcttgaagttgatccataaaagcttgtgtctttaatatagatctttttaaaagtactctattgttgttataattccactggctaagttgtgaagaaattaagtgtgcttttgagttggaggaacgcaatgagggcaacaaatcatcctccctacgcccctcttcaccatcaaacaaagtggtacggtcatcagttactccatggaaattactgcctaaaaaatgaccttcgttgcgtgagtaagtaagagtttgtggtactattgtggcggcatcatcgtcctgatctgtggagtccttgtgcggtttattgctgtctttgaattgttgttttccttcagacatcgttaaatgagcctaccgttttgcctctatccgtgatatcagataatgttgctatgttcggatgtactttgctttatttattaagggctactgtaacctgcgttatcctgtttcaataatgcatcgtccgtcttaattaatattagcccggccatattcttcagcatgaaaagctgtatttacccggactgcgcaccaacttttaaatattaatctccgttcggtctttgcgcgagttattatactagcgccacgtattagtaatactatagctatcttgccagataagggatcacaaggaattatataccgtggatcacaactatccatatcactcttcccaatttcgcggagaaatacttatgcaggtttccaaatcatttccgtagccaaagctgcctgttggccactgttttggcatctctctacatttttttttttcattgatactttcaacccagacattctgtcacctggtgaaaaacgacacaaactcctttgtaacaacaattgcaattttaagatatatgagaatattgataaggctagaaggatggtagtaagaaaagttgttgttggtaatttttcaaaaaagagtttcaagagctgggaaaagaattaaggcaatgggaagcgaaccgtttcagaaaaagaatttgggtctgcaaattaattcgcaagaaagtggaacaacccgctcaacatttcattcgctagaagatctaggagatgatgtaattaatgaaagctgggatcaggtgaaccaaaagagagccaatatagatcatgatgtctttcatgagcaccctgactcttccccatcattgtcagcacagaaagcaaaaacaaaagaagaggaagttgctgtaaagtcatcgaactcccagtcaagagacccttctcctgatactcaagcacatattccatatacttatttttccaaggatcaaagactaatcatttttggaattatcatttttataggatttttgggcccaatgtctggaaacatatatataccggctttaccattgctgcaaagggaatatgatgtaagtgcaacaacaataaacgctacagtttctgtatttatggctgttttttccgttggtccattgttttggggcgcactggcggattttggtggaaggaaattcttatatatggtgtcgttatcactaatgttaattgttaatatacttttggccgctgtaccagtcaatattgctgccctttttgttttaagaattttccaagctttcgcttccagctctgtgatttctctgggagctggcactgtaacagacgttgttcctccaaaacacaggggaaaggccatagcgtatttcatgatgggtccaaacatgggtcctattatagcacccattgttgctgggcttattttaatgaaaggaaattactggagatggctttttggtttcacttctatcatgacaggaatagcattgatcttggttactgctttacttccagaaacgctacgttgtatagttggtaatggagaccctaaatggggtgacaaaaaagatgaacgtgaaaataacgaatctccattcttcgaaggtaataaaatatcacatcggcgtctgttcccagacattggtatccgtaaaccagtcaataatgatgctttcttccaagaaaattttccaaagccgcctaaagcaggtttgacactatattggaaaatgattaaatgtcctccaataataatcacgtccgtcagtactgcactcctgttctccagttactatgcgttcagcgtcacgttttcgtattaccttgaacatgactaccgttttactatgttagaaattggtgctgcttatgtctgcccaggtgtagctatgttactaggatctcaatctggtgggcacctctcagattatcttcgttcacgctggatcaaaagtcatcctaaaaagaaattcccggcagagtttcgtttattactgaacctaattggaattttactaacaatatgtggcacaataggatacggatgggcaatcttctttcattatcattttgtggttcttttagttttttccgctctcactgcctttggtatgacctggtgcagcaacacatcaatgacatatttaactgagttattccccaaaagagctgctggaactgttgctgttagtagtttctttcgaaatgtgggcgctgccattagttccgctatcattttacagctctgtaacgcaatgggaattggatggtgttttacagggctcggtctctgcagttcaatttcattgattggtatattatatcttctcatttttcaaagaaaatatactgccaaagaattttaagaaatagtttatgtttagctataaaatttaacttttagaattttattatattatttaactttcaagaaaattttctcatcactcatcccaaggacttcaagaaatagaacaatgcatcataagtttatgaattacgtgcatttggaccttcaaagaataaaatcgaagttatagttaattatattaaattaagccaaaagtacatatatctaaaaggaaaaagtataaaaattatgcaggtccaagacatacttaagccttcaaagaagaagctcttctctttctgatttcggccttttcagcctttctttcagacaatctcttagccaacaattgagcgtattcggcagcagcttctctttgagcttgagcgtttctgaccttcaaagctctttggtgtctctttctttgcaatctttgaggagtaaccaatctttggatctttggagccttggtgtaagtcttttcacccttggtgacttctcttctgatgacgaaatcacgaacgtcatcttccttggacaaaccgaagaactttctgatgttgttagctctctttggacccaatctctttggaacagtagtgtcagttagaccttccaattcttgttcacccttcttgacaatgaccaaagccaagacagccaaatctggaccaacaatggcacctctgacggactttctctttctttcaccatcacgtcttggtctgtaacaagaaacgttcttggtcaacaacaacttgattctagttggcaacaaaacaccttgcttcattgggaaaccttgtttgtcgttaccaccagagatcttgaagacgtagcccttgaattcatcaccaacggcttcaccatcgacttcttgaccgattctcttgtcgaagaaaacacgaatacggtgttcatcatcaatttcgaaggtcttttgagacccgttgactgggtaagaaatgttcaactgttataaataataccatttgttagtaaagttgtccgaagccaatatcgacaaattccaacgaatccctgctgtcctttcttccgttacaggtttttcttattttcattgatatttctaaacccttttcgtaaattcctttttcattccttaatttgaacttagcgagatattttcctaagtgtcggtacgtgtatattagagggaattatctcgtttaaacaacgttgttcttgagaatttttattatagtgcactaatttgtgggtatacgtttatcaaacagtcagaaacagccggttagcgcgtgctgattcattagaattctaaggatttgggtgatattacataccttcatgatggctcagtcgtctattcacactggatagtttcaattaatgacttccaaatgttttgaagggcacactattcaaattaagatcacttttcataaagatgaatttttctcccatcaggcattcattgaccgtgccctacaaaccaagccagccgagattgtatcagctccacgcacataggattttcgcctgcccttggcccataccgaaagagtttcctaggatgatgggccggcatgaagataagcggcctgtatgcccgagacactgaaaaaaaacagcaaaaaaataagatgtatggagttcaaagatgtatggatgcaagaaaagaggttaatggtgcaaactgtagaaaaaaaagtaaggaaataatttatttttaataaaattaactgaaaagatacatgtatatttttctcaaattaatcaatgcaatatgtgatatatttgctatctggcttaatgagataattttttacataattatgttgagaagttaacagggcagtctctattgttttgatcgattgagtgcacaaaaattggaagggggccgtggagcactacctgcaaattgctagaaatttgcgtcactacatctgaaaaatgtacgagcgacataattgtctatagccctaatttagaagacgtttgcctaaatgcgccaacatacactcttaattttaagcgaatgctttcttgtagtaaaaagtagctagaaagcgattcattaatctggagagtttgtcgaactcgtggatttcaaagttgaactagctaccgaggaaggaaaaaccacaatagatgaagacgggcttttcggaaatttaggcggtcttccaattggcggtttcagaaagaatgttttgttatttacataagtgctgccacatcggccattatgatataagtcgtccatatcattgttcttgaatcccaaaaactttgaacgagaaagaggggaggacatgttgctggcgagcatttgattgggagtggcttgtacatccgttttcggtgatgcggttcctgaatacattgctggcgacctctggcaagcgtcatttgtggccttcggaatatttagctttaaatatggcttccctgagagctttcctctattgctgttcagttggtgcaggtgatggaccatcgcctgcactggagctggaccttccaaagtatttgatatagcaactgtcgggtgtatcttttgctttgcttcaaagctctcgctgtcacccgtcccattaaatccttttcccattgggttactatttgccggaataacctgtacaaattgcgattgaaaggatggaatattgcccactaaacttgcaggcaatgaaggctttggcaaattctcgtaaggcgacgggtaaaaattatgataattagagtggttagattcagaaagtagtaaatgagtatccggcctaatcctcttgttcataaaattcctatgaatagcctcgtttgcaacatgctgttggtctacgctttctttataatcattagcatgaaaactcccaccagaatttaaaccgccttgcaacatttgataatctgcactatttcttgcacagtcagaatgattggatccgctacgtgatattgctccgtggcaatgcaccaatggtgtacttacaccagcgttcccggcgtcatttgacgccaacggagcgcttaaattcccattgttttgtacactggaggaatcttgactcgaaactgtacaactcccagaatgggaagctggttgcaacacggttgctcttcttcgcctgcgcttcctttcattcagaacaacacgtggttttttcacatagtcaccataatcagatggttctatgatattatgaggaagatcagtgttgttttgatgaacattaagcaggttactcatatcaacagaagagtattcgtagaatgtattattggatcctaaaataatgacagcaatgtctacttggcaaagtactgacaattcatgagcctttttaaatagtcctgcttttcgctttatgaaagtaactgtacgatttctatcatctttgataggttcaatttcaatttttcttctacccatttagcagaaatttttttgaaaataattgtgtttgcttatctagagctttattaaatttttttctgatgagataggcctgctcgaaaaaatagtctgtctttgaatttggctcgtatatttctcccttcgaatgaatgataaagaaagactcaaaggaatgatgtagtgttatatagattggctaaaataatttggcaaaagaaagatggataaggatagttcatgtttttgagtccttcacgaacataggaagccgggtatgcgtggagatttaagttttgccaagcctccaattactcgagcgagattatttttgcagaagaaacaaagacgccgcttgttactaaaaaaagaaggcaacaataatgcaaaaagttcgaaccaactgtacctcaagccgttttgtaagccactatcatcgggaacggtacaggtagaatgatagatgaaatttacgtaagcgttaatggaaaacaataacgatgtggtgtaaaagctagtgcgtagtgtgagtgccactagttttctttgacagcttaagagcaagcttttggagctcacaatcaagtgaaacaagaattatgttcattttctccttcggaactgcagaataaaaattctttatactataaacaccgccattatcaaaaaagtattgctgaatcatggtatacagcgtgaaaatcttcatggcatttctacaaattctttttagttagtatcgccaaccattaacctttttagtaatgctgacgttaaacgaaggcgaaaaaaaatacttggcaacaccatcgtttatatttttttcaaatggaagtgtcggccgacgtagcatagcaggaaagattcaaaggcaagggtttcacataacgttacccttctgaccacgccccttctttcgatcccactagtgcggacggattatcacgcaagttttttaacgcgagacatcggaaaatatttatgccgattagatccggcccctgaaactttttgtttgatactttcaaacgcactactctaccccatgacataaaaaatatctgtctccggttatatatgtctaaatagaattcgggtagcattttatttttatcgcttataggaaaaagatatttgcatatatatatctatatatcctatatacatctatatagttattgtgtaaggggtttttataaggtccgatacttacagagattaatttgtaaataaaagcagaaatctttatttaagaaaatagaagattgatgggaatatttcgttggaactatccagagagttctgtccccggcgtttggggagaaacaacttccactattgactggtgtgaggagaactatgtcgtttctccctatattgccgagtggtcaaacactttaactaacagcgtattcatactgtcagcgatttacacaacttactctgcttacaagaataaattagaaaaaaggtttttacttattggcttcgggtacggtttggtcggagtaggatcatggctatttcatatgacactgaagtatagattccaactattggatgaacttccaatgatatacgccatgtgcattccgacatggagtttagtatgcgaggccaaagaggcattacttaacggagataatcacaagaaggttcctctatttgaacagatattcatcggcgtaattatcggcctggccgttacaacagcaagcatactctacgttatttacaaaaatgtcgatatccatcaaattttgtttggcgtacagattgtagttgtggctgctactgcaggaagtttgacgtacagatacgtccatgatccacttgccaaaagaaatctcaaggcttcaatggcgctcggcgcaattttgttcttatctggctacatttcgtggctacttgatatacactattgttcgttctgggtgcacgttagaagaagtattttggctttaccacttggtgtactgcttgaaccacacggatggtggcatatattaactggtatggggatttatttctacattgtttctttggaacatttaagggtcattacgctcaacgtcagctgcaattaccagttcatctggagatggaaagtcttccctgaactgatatggaaagggcgcaaaccctcaacaagatattcacttgaactatttggcccatacgtagaagatcaatcaattgaagttaaaaaggagaagtaataattatagcataatatatattcataatgtataggcatatttattttttattttttttatttcatgttctatttaatgacgaatcacgaagaaaatatatctaagaaaagatcttttgaatccttgatttgcgaatagtttaaatgacccagcttattgctctggtgaaaaaaaactttgtgcggtctcaaagccgtcggcggcaaaataacgtgaattgatgaaagtaaataaacaaaacaaaatctctaattgttgtaacacaaatactaagaaatttgttagctaattcgggacatgtaccaaaataatgtattgaatgctattttggcttctgaaaaatcaaactttcaatacgatagtggaacaatattaagaaaccacaaaagaccaataataacatttaataacaacatagagcacacagtatccgaacctaataattttacaggctatgaggaaaaggaagatttggatataatggatatttgtccttattacccaaaagcaagaatgctggcggatgccattcaacatgccaaaacgagcgcaagtgaaaacaaaatggaactatcaatgaaaactatcccatgtctcaagaaggaaaacgtccatgttgagaaagggcacgattggtctcaactcagtacgagcagaatttgtaaaattttagaagacatagcagataaaaaaaataaaactagaaggcaatctgccccattacaaaagacgaagtatttcccaacaaatgagaatcaaaataccgatatagaaaatcagaattggtcccaaatccccaatgaagacatatgtgcacttatagagaagattgctagcagacgcaataaaaatcgcaaacggaaaaatctttcatgttctaaagtccaagaaattcagggaaatattgatttacccaaaaaagacgtacaagagggagatatttcagattcgtctctatttgcagcagtaagaggaaccaaaaaagtttccggatatgattacaattcagaagataagatacctaatgcgatacgtcttccttactgtaagcaaatattacgattattctcacttttacaaatgaagagaaatgacttaatagtcacctctgaaaattgtaatagcggagttttcttcagcaattttaattatcaacttcaagttaaatcgaattgtattgcaaatatttcttctacactcagttttctaccccatcatgaaataaccgtatacacatcctttattctctatccaaacgttgtcgataatatttgggaatgcacacgatacgctattcaacttttgaagtccgaagcagcacagtttacgctactgcgtgatatatatagtggcttcacaattatactttcaaatcatcgatatcatcctaagggttttagcgctgattactgttacagtgcaaatgaattgacattatttctttttgttattcgaacagggcaaaaaaaagtactttatcgatctattcctcacaacacagcagcaattgaaaaagacagttcttttgatacagaaaatagaaagagaaggtccgaggaagaggttgttcttaaatgtaggaagtgttctaataattcattggcattaaaagaaatcagcacctatcgtttggatagcgcagaaggttttgagaagtctcagcctctaaaagatgaagcaaagctcagtgatatgaattatgtacaaggtagtatcagctataacaggactattcttaccggcttatggaaattatttcacagattgtgctgcaaagatcgttataggaaaaccaatctgtcagaaacattgttctatgacgattcaacggaaagatgggttagaatgggagagttaatgcactattgaaagggagatgcttcaataacttttttcatgaaaaactatttaataaatttaatatatatacttcagaatgaaaaacaaatgaatagtttttactgaatatgtaagtggtatgtggaataagaaactcaaatgaagcaatggctatttacagatgttccaaaacttttcgcatttatatacatattgccttagcttggaggtaaacgatatatatcaccgttaactttcattctgtgtatggcaactttagcatcgtcctcgtagcttttcggtaatttatcatttggtttactttcaaacaaagatcccattaaaatcatatcattagttgtagcatcacacaaaaaggcaatatagtctacaacgtcacggtctaacgtctcagtcttcttagtttgctgattgactttaattagtctttgcttcgtatcaaatttgtaaaccaactgtaaatgctctaacggcattccgggaatcatgattggttgcactgagactagtttaggaactgcattaaactttatcaactgccagtccagtgttgcattacctggaagttgacgggacctagcctcgagagcttcctgaacccataatgaaactaaccctttgatgtccgacaaatttttatgagcaaatgacgtgtttacattgatatacgtctctatggctttgtttttccagagtaaaaaagaaggtttaatgcctgattgaaaacgaaacaatgcgacttgaacagagttcaaaccaaacgtgtaaagtcttctgatcaatgcatttgcaacaatgagaggatgagcaaatacatttggaaggttcttgtaagccgaggggataaatatttcggcagcaacacccaggtgccgaggattaaaatcttgctgcttacttttatctttcttctttgtagtttcactttctttattcaaaattaacctcgaagttgaaaataatcgccgcttgttaaatgatatcaacaaggatcttggagggaagaaaaggcatgtagatcttaatacactcatctcataagcttagctgaatggataggcttgctttctgatggaaatttgccttgcttttccaactattccattactcaggttttatttttttattttgtaatatggggagaaggccggcagaatatttacggacaaatgaataaattggattggattgactagtggaacgtgtaaagatcgcgatactccgtaccaatcaccgaaagattgcccgtaaccgaaatgactccattctctgaattttttgtgaaaccaatatctgagactcttccttcatcttatcaacgtattgttcagtcaattaagtaagaagtatatttgagcgcagccttaatcatatatagcaccagttatatgtttgcccctctcttgagttgaaaaacacataatacatagtactgtacttttctctttttcatcgttggcgaaaatataatctttctcaaaaatatatatatatgtatatatatccttagatttgccgttgacaataaggtgggcggcaaatctacgaaatgcgaggcggttaaaagagagtgacaacattttcataaaaatattctgatctcaaactgaagacataaaataaggatatgagctacatagttgacctacaagtgcgaggatcatctctgagggttatcaaatgtatgtttagagaggatgagcaaatttcttctctacattctggttctgactcgaaacaaaacagcaacaaaaagctgggagaatttttgaatctgttaaaagcagtggtcaagaggaagttggaaagtttcccaaaagaccgtttaaagacttcgattataactggccaagaattaatgagagaggggcaaggaagtattgaaattaaggatccaccaacggaggcgcaacaacatttgattagaagcctagcaaaagttttattacaccagttttcaagcataaatggcaaagttaacacagtaaatgaaggacaagataatttgtttctatccttattcgttaaaaaaatttctatagagcaacagtccacatcacacgtctctattaaattgaactttcatgagaaaataaatttgggtcagcacatagattctattttagattcagaggagaccaacgagtcggacacttatcacatgggatctgttgacgagttcattatatatcccttttgctgtctggaagagcaagatgagctgaaaaatggcagcatactgtccacagagttcgacaagattgacttagaactagacgaggatgatggttttgagggagaaactttaaacaattgtatcaattcggtgggaaattttgacattccactaagtaagcaaacactaaacttagtaaatatatcatatcttccaggcacaactttcgagggccaatgggaatcgttgtattttggtaacaatattaaagaaaggttatatagctacgcaactatatctctcaagatagcaagattcaaacaaactggagactccaatcaagaagacattacaacgctaatcacaaataataaattactccttgtccatggtcctccgggaacaggtaaaacaacgttatgcaaagcactttgccaaaaattatctgtgaggcgggaattttcagacggttccgataccattgatactaattataaggggataataatagaattgtcttgtgcacgcatcttttctaaatggtttggagaatcgtcaaaaaatatatcaatagtattcaaagacattgaggagcttttaaaggtcaatgagggacgagggatctttatatgccttttgatagatgaggttgaagcaatagcaagttcaagaacaaatttgtcaagtagaaatgagtcaacagatggaatccgagttgtgaacactttacttacgcaacttgacaggctgaaaaaataccataactttttagcattagccacgtctaatttattagattcattagatgatgcttttgttgatcgagcagatggagttttttatgttggaaatccaacagctgagggcatcctccacattctaaaggtttgcatagaggagatgataacttcaggtataattctttttcacgcaagatcaactggagtcaagttcttcaataaatatcaggacattttgcggaaaattgctatcaaatgctcggtatgtttttttcttttattctacttttacgattctttttctttctttccttcttcataaaaaagcactttcactaactgtctttgtcaaacataaatatgcgatcaatatagaccgttgatatcagtggtagaacaataaggaaattgcccttgatgtgtctgtctgaatacttccggacatttcctgtagacgacgatgagtttgttctggcattagctatgtcagcgcggaagctgagcgcagcgcggaagtgacggaggagctttttcctttttttcgcttctttcttttgtctcatactcatgtagcatactttcgcgaaccctattccaacgttttgttgttgctcgctttcatgcttaaaatttttattatgtattttacgatcaaggtgtatcgtgaaccacacgtttatgaaatccttattttagaatcaaaaagtcctacaatcttgtttgtggagtctatataaagctaaagttaggttctacaaagcaagatacaaatacgaggccatcgagtattcaatgggaaatatgataaagaaggcatctttaatagccctcctaccgctgttcaccgccgcagccgctgcagctactgatgcggagacatctatggaatctgggagttcttcacatttgaagtcttttttaatgtccgtttctatgattgggctttctgaaattggtgacaaaaccttcttgatcgcagccttgatggcaatgcgtcacaaaagagttctggtgttctcagcagcagctacctccctcgctattatgaccatcctttctggtgtggtgggtcattcagccgttgcttttctttctgaacgctatacagcattttttgcaggtattttattcttagtgttcggttacaaattgactatggaaggtttggagatgtctaaggatgcaggtgttgaggaggaaatggctgaagtggaggaagaaattgccattaaagacatgaaccaggatatggatgatgttgaaaaaggaggcgacactgcgtatgataaacagctgaagaacgcttcgattggtaaaaaaatagtgcacaggattcgcgaattagcatcatttatgttttccccagtttgggttcaaattttcctgatggttttcctaggcgagctaggtgaccgttcacaaattagtattattgccatggctactgacagcgactattggtatgttattgcaggtgctgttattggtcatgccatttgctctggattagcagtggtgggtgggaaattattggcaacaagaattagcataagaacaatcactcttgctagctcgttgttattcttcattttcgccttgatgtatatatatcaagcattcacaactcaggattgagatggtttgtaaccgtattcttcttggattctctcttttttctcttcatatttaagtgtgaatcttgaaaagaatatttatagacatacgtaactagtgtacggctgatatttatttgatgtagcttttttttttgctaagttcatcgcttttctttcccagccaacccaatgaagtcttgcgcacgcaattggttgtaattatccgatcagccgctatcatcattgtcacggtcgggttcctgtaatacccttttccttattattcccttaattttttcattcgttttcttctcgagcacttccataataggcgctaatttggctttgagatcgctggtttcgcaaaccttatcgatgtaacgctgatgttcgtttttttgggggataatatatggctgaccactctctttttgtttcgtcttctgaatagtttcttgtacaaaactattcgttgcgttagagctctgtcctgtttgaatcaccgtgtcatatacaggttcatttgaaatatttaaaccaacaaaatcattggcttcttctttgcctgttttgcccagctggttgatacgggcacgtaactgatttaattcttggtccctttctagtgataaatctcgcagagagggcatactggttgtaaaaagtagtcgcaacaagtaagtcgtaaaaaagtagatgtaatggaaggctttgaaggaacggctagccagcttttctgtatcattcctagcctaattgacagcatcttgaccttctagtatggaaactttcaatttcagaaagcggtgttccccgctgcgacgatttaatccgtacatttacacatctgtacatttttcatattcgcaaaacaaaggttacttgaaaaaatcataaagttggcggcttcaggtggacgcgcttcactcatgtagcttaacattcaatcccattaagcattatgcataaatttcatgaagtttacttaataaaattgttcatttgcatagacaagaaagaaagcaacaagacaactaagactaagcaacaatgccaagtacgtattagactatatcgaagaggagggaaattcttcactctgactcgttgattttgaaagaggttcgggtcctcataaatatttgagaatatgaaattccataatagtataccttcattgagtagcacgacaacagcctgaattactatccatattatgaatatctttatttacactgaactcccgacacttcagttaaacagggatacattagagatcaaggtgatctaatagggaacatctctctcgtaacaatgggacagtattttattttccaaggcggatacctaattatgcgtttttaatcatatctctacaatatttatgagcacttacttgggcccttgcagacttttgttccgggaaaacttttgactaacaagaatccaattttacttttttttttttaggagctccaagaacttactctaagacttactctacaccaaagagaccttacgaatcttctcgtttggacgcagaattgaagttggccggtgaattcggtttgaagaacaagagagaaatttacagaatttctttccaattgtctaaaattcgtcgtgctgccagagacttgttaactagagacgaaaaggacccaaagagattgttcgaaggtaatgccttgatcagaagattggttagagttggtgtcttgtccgaagacaagaagaagttggattatgttttggctttgaaggttgaagatttcttggaaagaagattgcaaactcaagtctacaagttgggtttggccaagtctgtccaccacgccagagttttaatcactcaaagacacattgctgttggtaagcaaatcgtcaacatcccatctttcatggtcagattggactctgaaaagcacattgacttcgctccaacttctccattcggtggtgctagaccaggtagagttgctagaagaaacgctgctagaaaggctgaagcttccggtgaagctgctgaagaagccgaagacgaagaataaataattcgctgatttcataactgtataataaattttataacttttcaaatcacggatcatttttcattttactttgtcatttttatttcatttgaaaatgggtagaggtacataactggcgcttttcttgcaagatgacatggcattggatgacacaagtattactcaatacccaacgtaaatagctagaagattttgatcggatttaaattcccaactgcaactcagtagcgtttaggattttacaccttggcttggagaaatccttattgtcagaaattgaagccgttaatatttaaaggctaattctccatgccatcttgcattcactttggtatatatctcttgacctcaatatatctcgataatataaatcgcaatattatacttgttagtctgacagttttacacctgtacatcttcaccatcaccacacccttttttactggaggcaaggatgagtttgaatatcgcctttttcccagccgctagaacatgctcagaaccgaggaaaagcaccgctgccaaacctcctttgatgtgttggcccaccgctactagtggccgtgctggaagcccaggcagcggtgggggccacaatacgagagctggaaaggtaaacggtctctgcgcctctgtgaaattttatcaccaatggagtgtcatgtctggtaaagataatatagaaagtagtgtgcaatttcaggcattaccgattgaactttggaataagagaaccaagacaaaaataactagcaacaatgggtaaatcgtatgtcatttaatcctatgaatctacagcacgaacgaatcatggtatctcaaaccgaacatatcgtcacagaaataaaaagatttaaagacgtgtctagtgtgaataaagcaaacatatcattagagcaaaatattgggcagataagatgatgctacactgattctgagaaaattacgtgacatgataggcttttaacgggctgtaagtcattagtttacagtcgttgctttgaaaattagttcaacattagaagtgtagtaattacaagccctttttccaaacattcggttatgtgctgggacgcatctcagaaactcgcaaaacaatagaatactaacatgatttcttataaatcttaattttgatttatttccttataatacagacacggttacagatctcgtactcgttacatgttccaacgtgacttcagaaagcatggtgccgtccatctttctacttacttgaaggtctacaaggttggtgacattgtcgacatcaaagccaatggttctatccaaaagggtatgccacacaagttttaccaaggtaagaccggtgttgtctacaacgttactaagtcttctgttggtgttatcatcaacaagatggtcggtaacagatatctagaaaaaagattaaacttaagagttgaacacatcaagcactccaagtgtagacaagaatttttggaaagagttaaggccaatgctgctaagcgtgctgaagctaaggctcaaggtgttgctgttcaattgaagagacaaccagctcaaccaagagaatcccgtatcgtttctactgaaggtaacgttcctcaaactttggccccagttccatacgaaactttcatctaatttacccgatgctggttttgtatcgaaaaagattttcaggttttaggttttattttttgtctatttttaaatatataatataataaaaaataaattgtgtctaatatccataatttgtacatttagattatttcttttggttctttattctgacctatatagactactcaacacagtcacttcatgtcatccagatattacttgcgttgagcatctcttttgaatcctcgcttcgggctctctcttagtgaaaaattaaccttacgccaaaatccaagaagtaaaattaaaaagaataatggtaaaagtctaacttcacatagagaattcaactttgtataaaggggtagccttgttctctatagaaactgttctttgaagtactgctaactgaggtaaaaaaatcggacgattttgtctttacgtggtcctatatttattgtgtcaaagtcacctacttacttacatagttgaccattctcatatcccataatttttcaaggagataaagatgcctaaaaaatccattgaagaatgggaagaggatgccattgaatcagttccatatttagcaagtgatgaaaagggctctaattataaggaagctacacaaattccactaaatttgaagcaatctgaaattgaaaatcatccaacagtaaaaccatgggttcattttgttgctgggggtattggaggaatggcgggtgcagttgttacgtgtccctttgatttggtgaagacccgattacaaagtgatatatttttgaaagcatacaaatcacaagctgttaatatcagtaaaggatctactcgtccaaagagtattaattatgtcattcaagcaggaacccatttcaaggaaacactgggaatcataggcaatgtgtacaaacaagagggttttagaagcttgtttaagggtttgggccccaatttagtcggggttattccagcaagaagtattaatttttttacctatggaactactaaagatatgtatgctaaagcgttcaataatggccaagaaacacctatgattcatctgatggctgctgcaaccgcaggttgggcaacggcgacggcaaccaatcctatttggttgattaaaacaagagtacagcttgataaagctgggaaaacatcggtccgacagtacaagaactcttgggattgcttaaaaagtgttataagaaatgagggtttcactggcttgtacaaagggttgagtgcctcttatttgggttctgttgaaggtatacttcaatggctattatatgaacaaatgaagaggttaataaaggaaaggtctattgagaaatttggatatcaagccgaaggtacaaaaagcacatcagagaaagtcaaggagtggtgtcaaagatcaggaagcgctggtcttgcaaaatttgtggctagtatagcaacatatccgcacgaagttgtcaggacgagattgagacaaacgcccaaggaaaatggtaaacgaaagtatacaggtttagtacaaagtttcaaagttataattaaagaagagggactcttttcaatgtatagtgggttgaccccgcatttgatgagaacagttccgaacagtataattatgtttggtacatgggaaattgttataaggctactatcgtagccttgaaatctaaaaaactctaaattcactttagggccaagacatactctaacaaaaaagtatgaaaaaagtgcattttgtaaggatataaagcctgtcaaagtttatagaaagctaacctactaaggtttggaccccttcgtttcttctcctttactttgcattatttatcgtaacatatcaatgatccttatttacttcattcagtaaattggtccttttatacttgtaaatatttttaccaggtcactagtaacaataaaatgttttaaaatatcagtagcgtgaagtaaaattcaattactagatgatgttgaagtagatcccgtaataatgggcttttcccctgtgaaggtgaactttagaacatcatccacattgaaaggtttcgaaggtttgctatctcgtactagaagtgaagcgtgttcttcgcttagggattcttcatttttgaaatcgtgctttccatattcgtttctaaacgtagtgcgcgcccaattcgttatttctctgtcctgttgcagcagcttttctatttcttcatcctttagcaaggctgtagttactccagatgtttccctaacatatttcatccattcgtccacttcaggaatattcttcttcctcaaaagggtagtgaccaaactttcatgagaggtggttgggaatttaggcaaagggtaaaccactgtagagtctaaagtttcttggaaatgttgtagagtggaggttacagaaacgagctgggataatgtgacattcagttgtgattggagtgtataccattgtggcagttcggctttggacatttcgtctctgattctcctcaatgaatgagttaattgagccaaacgcatgcgcacggcatctaaagcctggccaggtacaccattgaaatcaaaactaacatcttcttggagggagccttgattgccctctggtaccagtgatgcagtagattgtgacatattccacgttgctttatgtttttcttttgttcttcttgctcggggttctcttatatcgatgaaatatttcaatattaaaatccttaactttgacgaaaaggcaatttttgtatattgagtttccttacttttttgaacagaacgtacttttagacactttgcaaaggccttcagcaaatttttttgattattttcaaatatcaaggaaatatattaccttcaaagtcatccaatccttttagttctcgcattccatcattttatactatatacgtttgagcttaatggatcaaaagaaggacccaagtaataacttaacagaaagaagggtttccaaggtccaacgcccaaataagaaaaaggtacgaaatcaagttgaatcactttctagaaacctagagagaaataaagagggacagcttctgcagactgtatcaaaaggtcatttagaagctgattctggacactcactgggtcgtgaaaaagagaacggtgaactcggtataagaagtatattttacgataaagactggaatccaagaggcactgcaccatcacattacagaaatataccttataatcctgccactttcaaaaggcgaactgaagttcaagccagactgggaaacctcgagaatatcaaaataccaaagtgaaagttcaaaggtaataaatgagcaaccactttcttcgaaatacaatattgaaatcagcatgaagtctgagcgtagtgtttattgtagcaagtcttgagcatattttataaactctatttatgtttgtatattcgtctatcaaatggttgaatatgtaatagggacaggagccattagcatgcctggcttcaaggaacgtttaggtcacgaatgtccaacaaggtttcctgcaggtttccatatgtgaactgaattatcatttgccacactgcacattaaccaagggtcatgagcgtcccacgaaatgtcgttcacaccgagcatatgaccaccatgggtaaatatagtttcttcgcaggaggtatcccatagcttgactaacccatcttcttggccagccgttgccaatacagtatcgaaatttggactccattctaaagttgaaacggaagtaccgtgctccatggtagcgattgggcttttgttcatgtttctaatatcccataaatttagcctcccatttgaatctgcagatgctagaattaaagagttcttatagttaaatctacaggagtttactccaccatcgtgtttttcacggttactctggagcttctctttcttagtcctcagatctaatagggagaccgcatttccttcagtacaagcagcaaagagggaatcgtgtgttggcatccaagttacatcattcaccgctgttccgtcgctgtttattgacactaagggtaaatctattatagggttctcatgcgaatattgtttaatgtcccaaacttgaacttggccgttggagtgagaagaaagtaaaagggcctcctgctgcaagttccaggctaaagaagtcgcctcatttatatctgccgaagaagtatccattgcctccacgtcttgaataacaccatgtgaaccaaacagctttgtctcaaagggatgtgaaattttggactgtcttattctagtagagccgtgttttgttctatcgaatatgtagattgcaccatctgaagaggcgccggctataatatctggattttgaggcaaatatcttgccctattgcattccccgtttgggaagaaaatactgatgtcatttactaagtgtttggagggaaaccttgtcgagttctccggtttgaattccatttcgtccatgtcgaaattatttaaagatgaccattttatatgacccaacgtggatattttgctaatatatatggtctcatcttcaggtttttgggaagatgtaaatgaggataacaagatgcgatgctcatccgaagtggtatctaaatcaggaaagaactggcacgttaaggacggccactttgttgaattcgtgtttaggtaatcataaagtagtttagtgtttttcttccagtgcgagtatctttcttgcaaatcgatgggtatactggaggcttcatgagttatgtccttcgcgcactgattcatctttgaaactaaatttgtatattgtttgtcagaaataggacctgatatcctccttttaaacagttgatgagaacctttttcgcaagttcaaggtgctctaatttttaaaatttttacttttcgcgacacaataaagtcttcacgacgctaaactattagtgcacataatgtagttacttggacgctgttcaataatgtataaaatttatttcctttgcattacgtacattatataaccaaatcttaaaaatatagaaatatgatatgtgtataataatataagcaaaatttacgtatctttgcttataatatagctttaatgttctttaggtatatatttaagagcgatttgttcacatccattccttgaattgattgattaaaccgttggtagaagcatcgtgggtagaaatggtggaggagttgtccaattccttgccgatgactttagccaagactttacccaattcaacaccccattggtcgaaagagttgatattccaaatggcaccttcagtgaaagtaacatgttcgtagtaggcaatcaaagcacccaaagtagctggagtaatcttttgagccaagatagaggtagttggtctgttacctgagaagaccttgtgtgggaccaaaccaccagtggcaccttcagccttaacttgttcttcatccttaccaaccattaaagcttcagcttgagcaaagaagtttgaagccaacatcttttgatgtaatttgttctcaattgggttatgagattgagcagctaagatgaaatcagatggaatcaacttggtaccttggtgaaccaattggaagaaagagtgttgagcgttggtagctggttcaccaaacaagatagaaccagtagagtagtcagtaaacacgttacctctggtaacagacttaccgttagattccattgacaattgttgcaagtaggctgggaatctgtgcaagtattggtcgaatggagcaaccaaatgggtttgagcaccaaagaagttgttgtaccagacagacaacaaaccacccaacaatggaatgttgtcttccaatggggtttgggtgaagtggttgtcgacggcttcagcacccttcaagaaagcctcaaagttgtcatagccaatgtacaaggcaacagacaaaccaatagccgaccagacagagtaacgaccaccgacccaactttcgaaaccaaacatgtttttggtgtcaataccgaacttggcaacttcggtttcgttagtggacaaagcagcgaaatgcttagcaatgtgagatggatcattacctgtcttcgacaagaaccagttcttggcagtgttagcgttagtgatagtttcagcggtagtgaaagtcttggaagcaatcaaaaacaaagtagtttctgggtcaacaaccttcaaggtttcagcaatgtgagtaccgtcaatgttggaaacgaagtggacatccaagacaccagcgtagtgcttcaaagcctcagtgaccatgactggacccaaatcggaaccaccaataccgatgttaacaacatcggtgatcttcttaccggtataacccttccattcaccagaacgaacttgttcagagaactccttcatgtgcttcaagacagagtcgacttctggagcaacgttgacaccatcaacgtacattggcttgttagctctgtttctcaatgcgacgtggtagacagcacgatcttcagtggagttgatgtgttcacctttgaacatagcatctctcaaaccggtgacgttagcctccttggccagttcaatcaatgcagcaatgatttcatcgttgaccaagttctttgagtagtcgaacaagattttggaaccatcatagttggtgaaagtcttgttcaatttttcaaaacgcttggcatctttttggaattcttgcttgacagacaaagtcttaccttgagattcataaattttttgcaacttagaccaggctggcaattcagtggccagtttgaagttagtgaatgagttattggacatttttaggctggtatcttgattctaaatcgattttgcaagactagaggaatatgtattaaaattcactgaatgcaagtaaaatattaagtaaaagaaagcattgattatgaagaaaggacctttttaagatatgagaacaatgagaaaaggaaaaatgggacgaaacaaatagggaaaattccgtctgtaaaaccaattgtagtaacaaaaaacgctcatttcaatagcaaaaaaatagaataccgtcaatggatatatatagacacgggacattataacaacgtgcagatggtgatgattgcaaacccaaaaaattaccagcttcctgtaattccaggttgagcgcgtggcttcctataatccaatacacccacacccacccagatcgtgatttttgttaccatcccggttcttgcctcattgacatatttttctgacggtgacagaacgtggccttgtacactcttttttaatgttacgctggcacaacatagttcaacgaaaaacgaattaagttcttacttccgtgttttaatcagaaaacgatattccaatgagagatataagcgtaaggtagcatgtccgatggcaaaattctctttgcttccgcagcggggccaaagtcttactcgcctctaaccccacgtaggacaagtgctgagaataaaatagtcttggcgtagtatgccttcttcagtaatattttttcttttgaaagtactacccacatccgaacattgccacttacatagcgatgcaaatagccgccaggaaatgccgcatgttatccactaagaatagtcaacattgcatagcatccaaatacgtgaaagcggaccgatcttgagcgaaatgtttagtaccgttgatgtgtagaagtagtgccctgaaatacatagcggtgtattatttagcattaacatacaaaaaaaaaataacggaggcaccaatggaagtggtgtcgctacattagtttttaactcagtcagaaaactgaatttagttgatatgggaccgctccaaggtaggagaatactagatcaagtaaagcaaccgcactagtgcctttttcaaacaaggtggtttgatgaggaggctttctacaatcctagaaatataagacatctgtcagattagccgccgttcatatggtttcaaaaggttgcgaatggagacaaacgttcctcgtcccaaattagccagacggaacaggacaataaaggtgataatgtaatccatgacttcctctattttagacgggacttttagcatcctctaaatattttcaacccatacatgtcatcagcatcggtgaacatctttaatagtatcgacaacttggctcacgtacttctcaccgtcaagtgcgatttccgggtcatgcaatacctcgtctggttcttgatctttattcgtggcagaattatgctgatccttatgaggagggctcctcagcttggcatactttagtcgctgatttctttccctcattaatcgcagtagttgagcgtgcgacttgcgcatttgcgtgagattgctctcaaaatctcgtgggaacccgtcgttgacgataggttctttcgccatcttcttcacatcatccagtgtatcgatttcagaccatgatacgtcttgcgtctccgtaggtgccaggtttgagtgcattgttatacggctaccatttacgcttctttcgtatgcagtattacccctactaatgctggtcgttaaggggtttagtgctggaggcgtggttaggtttttggtcggaagtgcgttggaactgcccattatagaggcagtggaatctgaagatccctttcttttatctttgtcgctctttgcctttaattgaaccagctgagggtttccttcctggctactagatttccttctgttggtggaatccgcgtcgcttactttcacctggactggtggggtttgcttcactcccattatttgtcttcgttcgtgccagcaacatacatttcatcttatttctctggaaggtttttacaacaaccagttacatttttcatttttctgttcttcgcctttcttgttttggccccgatgactgagcgaaaaaaaaaaggctaaagaagacgctatgataaccgccgagcaggtcaagtacgatgtcgaaaaagcatctaatagttacatatcggattaggttatacttattacatatcacttccatgctgttatttttttcagtgtgaattatggcctgaaagcacctcctgcaagggctaaattgcttctgctgaacttgaccttaaaaacaggcgtctttttggtgtagaacgacgctactaaatcgcttgtaggtattactgttcttctgcgaccatattcttttatatcttggtttatagatgcagtaacgtcacccaagtatccaatgaatggctcatctggttctgcgcttggctcagtagtggcctttttcaaatcccatacacggactgtatgatcggcacctccactaataagtacgtttccctctttgctatatgataaggaataaatggcattcttaccatggccacgcatttgtttcaaccttttgccggtaccaatatcccatacattaataataccatcttcgctaccagtggacaaccacctaccatctggacaaacagcaatagaaatgacgggcgcagtatgtccaagaaataacctaaccgagtcgcctgtagaaacgtcccacattcgacacgtcttatcgctggatcccgtaaacacatagcaaccgttcggatgaaatgacacacaatcaacatcatttaaatgtcctgcaaatattcttaatggatatatgtgatcgcatgaccataaccttgcggtttggtcgtgcgatgcagtggcgaaataatggcctagcggggagaaactaacatcccacacagggtgattatggcccttatagcttactagcgcggtgtgagtatccatggaccatagcctgacggttttatcttcagaaccagaaagtaaatacttattatccggactgaaacttgttgaatatactgtaccactgtgccccaccaaagttttacacgttgggtcttcatccttgtcgttgttatttaacgcgatgttaggattattaagtgatgagccgtcgagtgaccagatcttgatataactgtcttgaaagccagcagccgctatcctacaatcatcactgaaatctaaacatgacatgtctttatttgtgttttggaatgtatacatgcacacgcttggtaaggccaactgtaaattatctagtttgatggcatcacgagattccttgaccttctgaatctccaacttcaaatctagtgccgtctttggtggtaaaggtaaaatatcacgtgctggcgaagataaattgctgtcttttttttcaccatccaccttcaattcgctctcttttttttcctcatctttggcgattttatctttaattttgtctttatcatcgtcgccagtattatccttaaatttttcgttattcatagctttatattcttgcaataaggttctattgttggctccactgtaattgtcacctgcagtttgttgatttagttgtttctcttgatcatccttaattttcaattcagtttcaatctccttaacaaactcctcgtcttttgggaaaggtcccagcttgacaggaacagaattcatttctaaattttgtttaccatttccgttttcactatcactgagaacttttattccatcagccaatttttcccttgcggttactgattctacaatatttggatctaggtgctgatttattacactaattattaatgaacctccaatactctcattttcattcaaaaaatataagagaagatttaaagtggttttagacatagtaattctgtacttgtgagattggaaagcacttgcgacctcattttccttgatgtgatctatagaattgacactgaaaagtctattaatttctgagccatggaagtccttaaaatcgggagaaaatctatcaaagaaacgacgggcgtaaacaggatttttggccaccaaatttaaaaataaataaatgaatattgggtacatgatgtagcttagttccggcttgtaaatttccagcgacgaatctacccagtttttcaacattgaatatgcacgtatataattttcaggtgcgttgagcccttctagtcgcccgctagatactataccaccttctgcatctctcttggatgacaaattagttggattgcttatgggtttagctgtcttcccggggttcggaggaattgatgattgttcaggaaatttacctgttttagtatttgctggtgattgtttgttttgaggtgttagtgtacgtccactctcggctctcagcatggcctctgtacggtggtatccctttttattcaggtactctaggacaattctattcaagtctgacgccgaaaacggaccattggacctcccctgctgttgagactggccttgactctgttgctgtggctgctggccggaattggcgccagcagcattattagttcgttgattctttactggttgtggctgatgcgtgccattttgattctgattcgtactttgcttctgtgacattcttatttttcaagtatctcaacttgaacccggagtttctcgtatcttttctccttctcttttcctacccttatgcctgctttattgctctttctgccactttgtagacttcatttgaaatcttgaaacttttttgcttttgaacaattcatctgaacccgtaaaagatgatatttacagctacttttacccggctaaggggagaattccattcaacggaacgagctctataagacgttctctaactgcatgtagtgaaatattttgaaccatttgatatgcagatactttcacggtgttgcacggctgtataatatacaataggccgttacagcagaacacaatttttagtttagacccaacaaggtgaaccatacgaactgatatgaggtttctttcaaaaaggatactgaaacctgtactttcagtgatcattctaatatcgattgccgtaaccgttgttctttactttttaacggcgaatgagaactatttgcaagcagtcaaggatagtgccaagtcccagtatgcttctctccgggagagctacaaaagtattacaggtaaaactgaaagcgctgatgaacttcctgatcatgatgctgaggtgttagatagcataatggacaggctacacgagcccctttatgaaaaggacacttttgacccgaatgaagtccttgctgaaaataaacagttgtacgaggagtttttacttcaagaaatttctgagccaaaggtggacaatttggtacgtagcggggatccgttagccggcaaggcaaaaggaactattttgagtttggtgagaaattctgatttagaggatataatttcttctattcaacagctagaagaggagtacaataagaattttggatatccctataccttccttaacgatgaggaatttactgacgaattcaaagatggaataaaaagtattcttcctaaggaccgtgtagtagaatttggcactattggtccagataactggaatatgcctgatagcatagatagggagagatacgaccaagaaatggacaaaatgagtaaagagaacattcagtatgcagaggtggaatcctatcataacatgtgtcgtttctattctaaagaattttaccatcatcctctgctatctaaatataaatatgtgtggagattagagccaaacgtgaatttctattgcaaaattaactatgacgttttccaatttatgaacaagaatgacaagatttatgggtttgttttgaacctctatgatagtccgcaaaccatcgaaacgctatggacttcaactatggattttgtcgaggaacacccaaactatttgaacgtcaacggagccttcgcatggctaaaagataactctcaaaatccaaaaaattatgattatactcaagggtattcaacttgtcatttctggaccaattttgaaatagtcgatttagactttttgaggtcagaaccttatgaaaaatatatgcaatatcttgaagaaaagggaggattctactatgaaaggtggggtgatgcccctgtaagaagtttggcacttgctttatttgcggataagtcaagcatccattggttcagggatataggttatcaccatactccgtacacgaactgtccaacttgtccagcagattcagataggtgtaatggaaattgtgtaccaggcaaattcactccttggagtgatctagacaaccaaaattgccaggcaacctggataagacactctatgtctgaggaagagttagaaatgtattgaagacattagctttgagaatttgtgccgctgctttcgagaacggcatcacatctggggttttatgatttaatttaggacgcacatagatagatatatattatggaattaagaaaagtttataatgtagcaacctaaaaatgttacaggtgaacattcatggaaaatgaaatgtttctcagccagtagatagtattgttgaaggtattattggtttgagaaagctactcctcaaaaatgtcacttgataatatggaattataatgtcgttatattttcaatcatttcaatacaatatggtaaaccgaaatccaaaaactttacaatatctcttatctattgttattcgacattcttcccgggccttaacggcttcttaactaatattaccctaaacggacaaatggcgaagggccccattcatttacgaacaggaaaaaaagaaagtgacaatacagccataatttgatgtaccatcttaatcagcatatgttttcactaatatactaaacccatatggatgcacgttgaaagcactgtgtgaaaagaaattgtcaagaaagccatataaatgctgaaaaacttcaaactctcaaaaagagatagtaatgggtcgaagggcagaattacatccgcagatatttccacaccttctcatgataatgggagtgttataaagcatattaagacagtaccagtgaggtacctttcttcatcttccaccccagtgaaaagccaacgggactcttcaccaaaaaacagacataattctaaagatattacttctccagagaaagttataaaagccaaatacagttatcaggcacaaacttcaaaggaactatctttcatggaaggtgaatttttttatgtatctggagatgagaaggattggtataaagcttcaaatccttctactggaaaagagggtgttgtccccaaaacctattttgaagtgtttgatagaactaaaccttcctctgtgaatggatccaatagttcaagtcggaaggttacaaatgattcattaaacatgggatcgttatacgccattgttttatatgactttaaggcagaaaaagctgatgagttgacaacttatgtgggagagaatttgtttatttgcgcccaccataactgtgaatggttcattgctaagccaattggtcgacttggagggcccggccttgttcctgttgggtttgttagcatcatagatattgccacggggtacgcaacaggtaacgacgtaatagaagacatcaagtcagttaacctaccaactgttcaagaatggaaaagcaacattgcaagatacaaagctagtaatattagccttggttctgtggagcagcagcagcagcaatccattacaaaacctcagaacaaaagcgcaaagctggttgacggtgaattattagtgaaagcatccgttgaatcctttgggttagaagatgagaagtattggtttttggtttgctgtgaattatctaacggtaagacgaggcaactgaaaagatactatcaagatttctacgatctgcaggttcaacttttggatgcgttcccagcagaggccggtaagttgagggatgcaggtggacaatggtccaaacgtataatgccctatatccctggacccgttccatacgttaccaatagcataacaaaaaaaagaaaggaggacttgaatatatatgtggcagacctagtgaatcttcccgattatatatctcgctcagaaatggtgcattccttattcgttgttttgaataatggtttcgacagagaatttgaaagagacgaaaatcaaaacaatattaaaacattacaagaaaacgatacagcaacctttgcaacagcatctcaaacttctaattttgcctcaactaaccaagacaacactttaactggcgaagacttgaagttaaacaagaaactctcagatttatctttatcgggctccaagcaggctccagcccaatcaacttctggattgaaaactactaaaattaaattttattacaaagacgatatttttgctttaatgctgaagggtgacacaacctataaagaacttcgtagtaaaatcgctccaaggattgatacagataattttaaattacaaaccaaattatttgatggtagcggggaggaaattaagactgattcacaagtcagtaacataatccaagccaaactgaaaatttccgttcacgatatttgaatctagtgttagaagacgaagcatttttcttctttacttggcagatgcacataggttgaacattttaatcaactttatgatgatttgcgagagtaataagattctcccgaacagtaataatattaaggtatccaattcttccgaaacagcgtgatttgtaataaaaataaataaggacatatatgtatatagaaagttgcttaaactttttagaccacttggaaatattttttatttatatttttcttcaaatgtaaagttgggtacctaagcttaaattcacctgaaaatgaattatatgaaagattttacaccacatgtaaaaaaaaacgtacaaaaagccaaatatttccactcaatcataatgcatgaattataggtattttaagttatattgctgacgtaaaattcagaagagactacaagaaaaattctgaacatatttattcttaaatatgcttttgtgcttccatatgtgtcaaaggataatgtggctccctttcgatttaatgaagtggcgtagatttcattgtggcgctgttcttgttggaacactgagcttacgtaaccgcagcccaaagatactttctctttattttattagcgataggacaggctaaaatgataatcactattaatcaagcagaaagtaattgaaattattgtaaatcgaaatacctgtaatgtagcaaaacttttcgtggttgttacagcaactttttatacttaatatagcaagagtatccgtttttataaggcctacacaacggaatcctcttgatttccttttttctttgtaatttaccgacgcacgaatacgcgcgctgtcctttttcaaccatccatataaaccataaatggcccaagatagatgtgagtccctaaattgaaatcagttgaaaaacagaaggtataacaaaaccagatagacacctaataaagaacaaaatattcctatagttttgctgaacatagtttttattgaaagtttagaagaattacagcagagatttcgtcaccaacagaagaaaagctaaagcccaagcaatatggatgctgtaatactgaatctcttaggcgacattcctttggtcacaagattatggacaattggctgtcttgtactatcaggtctcacaagtctccggattgtggatccagggaaggtagtgtacagttatgatttagtattcaaaaagggacaatatggaagactactttattcgatattcgattacggcgcatttaattggatatccatgataaacatctttgtcagcgctaatcacttatcaactttggaaaactcattcaatctgagaagaaaattctgttggataatatttttactgttggtgatactggtaaagatgaccagcattgaacaacctgcagcatcactcggtgtgttattgcatgagaatctcgtgtactacgaactgaaaaagaacggaaaccaaatgaacgtacgattcttcggtgccattgatgtttcaccatctatattcccaatctacatgaatgcagtaatgtattttgtatataagcgtagctggttagaaattgccatgaatttcatgccaggtcacgtaatttactacatggatgatataatagggaagatttatggcatcgatttgtgtaaatctccgtacgactggttccgcaacactgaaacaccctaaaggaaaggccgtttttatttaccaaaaaccaataacaaaagtgaacgcttgataaacaaacatacttagcataaataactacatataaaataggccaaggataaatgaaacgttgactagaatgaatgaaagatgtgaaaacagtacagttaaaactgcaatcccacaaactaaaaataatatgaagaacctgtctcaaatgtataaatgcagaataaataagtagccgaaaaagtctcggtaattttctccctaatgataacccatattttcgaaagactctaaaacctggtgtatgatcgttgagaacaaaattcgtccttgtagtagtgtgtgtctttagaagccattcgggccggtagaaggaaaggtgttgttagtcccagagtgatgtaagcaacataaaacaacgtcgtcagctttttactgggagcacttgccttgtatgatttagaaacttgtgaaaatgatttcatggccagcattgttagtcctcgatcttttgtgatatttcctatatattacaaaaaaattcttggttttcgccttgtcacagggaataaatgtggaatataaaagagaggagaggagaggaaagaagaaaaaaaacttggtgtccgtttgcagatggcctattatataccctgcttatataactctgagaattaggaatattttgctgttgctatggtaattaacatatttccaacaataatgaccttctcgagctattgtcttccttgcagtggcgaagaaaccaccggagagttgcaacgaactgcctttcttaggaagtgcgcgggctctctattatgataggccgatacggtacaaaagcttaaagttgcctttgtattaccttttttaatcgcagcaaacaatgcgaagcacaggtgttcactttccttagcttccccttttccgtgcttttgtttatacttcgtacaaaaatgaggggaaggtaccaggcaggatacctcactgattacgacgacaaggaaaagagtaaaaataatttactgtaaaacttccaaatttgtctgagagcaacagaatagaagcacaaagaaatgtaccctacgagagacagagagggtaaaagagtaagtaaattctaaagtggtgtgaatgtcataacttaaactattacccacgggatacctgctaggtcaacgtagccgctactcgaatataataagcgcttcttgtatattttctcaataacaggcgaggccccttctacccttgaatgctacttattactcactcataatacattgtataagccttcgtgtttttcacggcctcgaaaaaatttttcttaactaatttacccagaaaggaaatttccttataaggaaaataaatgcaattcattaagtcggtttgcttcttttttcacgaaagtgagatacaagcaaaggaccagagcgagatgtactacagtagcaggctacatacacgtctttaccaataacttacatttagaaaggcaatataatcactacctagattagcttgaatcttgcaggaagaactcaatacagatagaccagattatgagtgcggcacttccatcaattcagcttcctgtcgactataataatctttttaatgaaatcaccgattttttggtgactttcaagcaggatacgttgtcttctgatgcaacacgaaatgagaacgaagatgaaaatttggatgctgagaatatcgaacaacatctattggaaaaggggcccaagtacatggcgatgctacagaaagtggctaatagggaactgaattccgtgattattgatttagatgacattctacagtatcaaaacgaaaagtttctccagggcacacaggcagacgaccttgtgtctgccattcaacaaaacgctaatcacttcactgaattattttgccgtgccattgacaacaacatgccgctaccaacaaaagaaattgactacaaggacgacgttcttgatgttattttaaaccaaaggagactgaggaatgagagaatgctctcggacaggaccaatgagatccgaagcgaaaacctcatggataccacgatggatccaccctcttccatgaatgatgcgttaagagaagttgtcgaggatgaaactgagttatttcctcctaatttaactagacgctatttcctttattttaagcctctatcgcaaaattgtgctcgtcgttacaggaagaaagcaattagttctaaaccattatctgttaggcagattaaaggtgacttcctaggccaattgattaccgtcagaggtattatcaccagagtttctgatgtcaaaccagctgtggaagttatcgcatatacctgcgatcaatgtgggtacgaagttttccaagaggtcaactctcgtacttttactccgttgtcagaatgtacttccgaagaatgttcccaaaatcaaacaaagggtcaattgtttatgagtacacgagcttccaaatttagtgcctttcaggaatgtaaaattcaggagttatcacaacaagtgccagtgggtcatattcctaggtcgctaaatatccacgttaacgggacgctggtaagatctttatcgcctggtgatatcgtcgatgtaactggtatattcttgccagcgccctacaccggtttcaaagctttgaaagctggcttactgacagaaacttatttagaggcacagtttgtccgtcaacacaagaagaaatttgcgtctttcagtctgacttctgatgtagaagagagagttatggaattaatcacctctggtgatgtttataataggctggcaaaatctattgcaccggaaatctacggtaacttggacgtaaagaaagcgttgctgctattacttgtcggaggtgttgataaaagggtaggtgacggtatgaaaatcagaggtgatatcaatgtttgtctgatgggtgatcccggtgttgccaaatctcaactgctgaaggccatttgcaaaatatcacctcgaggagtgtataccactggtaagggttcctcaggcgttggtctgaccgctgccgtcatgaaagatcctgtcacggatgaaatgattctagaaggtggtgccttagtactcgctgataacggtatttgttgtatcgatgaatttgataagatggatgaaagtgacagaacggcaatccatgaagttatggaacaacaaacaatttcgatatccaaggcggttatcaatacaaatccgggcgccagaacctcaatcttagcggcagcaaatccgttgtatggtagaattaatcctagattatcacctctggacaatataaatctaccagctgctttactatccagatttgatattctcttcttaatgttagatataccaagtagagatgacgacgaaaaattagccgagcacgttacatatgtgcatatgcataataaacaaccggatttggacttcactccagtagaaccctctaaaatgagagagtacattgcctatgctaagacaaagaggccagtgatgagtgaagctgtaaacgattatgtggtgcaagcttacatcagattaagacaagactccaagagagaaatggattccaaattttcctttggtcaagccactccgagaactttactaggtattataagattatctcaagcgctagcaaagttaaggttggctgatatggtggatatagatgatgtggaggaagccttgaggttggtccgagtctccaaggaatcattgtatcaagaaaccaacaaatctaaagaagatgaaagccccacaacgaaaatctttacgatcatcaagaaaatgttacaagaaactggtaaaaacacgctatcatatgaaaatattgtgaaaactgtaagactaagagggtttaccatgctacaattaagcaactgtatccaagaatattcttacttaaacgtctggcatttaattaatgagggtaacactttgaaattcgtggatgacggtaccatggacacagaccaggaagactcactagtgagcacgcctaaactcgcaccacaaacgaccgcttccgctaatgtgagcgcccaagattctgatatcgatctacaagacgcttgaaagttctaaaaaaaaaagcaacagggccttcattctttattctttttccccctttttttcatttccatatagctgcacattcaaatttaccttctgtaacttacttccaaggcccagttttcaagatatgtattctgtattattataattttactaatattattcatcgcttttgccagccacagaccccacacatttcggacttaacattatgactgcgcatgtccgtgcaccgcggcccaattcttgtttttttttttttgcggagaaaggaaaattatcttcaagcggaatagggccagctagtattgctcagatgtgcctgtggagagccgtgctacagggtaccgtcagcccctgagtataccagagagtacaccgtgcggagttcttccagaaaatgaaaagattgttctcagaataattcgtagcgcttgataataatccgaatttgagatacctgccggcacccattctgttatcgccaagaggacttttaggggacccgcagacagtaaaatttttttcattcattaacatgtgaaggcaacattcatcgatctccatccctactgtcaaaaatataagtatatatatatatatatttatatagtctatatatatatagtcccactctcaaactaatataacctttacaaacctgtccgctcagtacggtagtcctattttattccgtttactagattatatttgaagatatttttttattcttgaaaatcccggacgatagtatttttagctgaagaatatttgcggggaggaactatatagacactcgaagcaagaggggaaaaggagaaagaaaaaaaggtacactaaacaaggtcgagtgtattgatgtcaagtgcttcaagacttcaaaacgtcaatattgtttctaacaactattctcgttacggaacttccgtttacgataagttgtatcatagtaacggcagtggtagcaataatgctggtaagaattctaccacagttggtaaactgtcatctatctcacaaaagtccaggagcaaacagcgtcatggctcaaattgctccagatcaatgagtcaatcacccttatcgacgttcaaatctccactcagcaatcaaaatcaatccagcgctcctgatgatttggcttccataggtcagagacgcagtgacgacgtcacatctttagataatgaaactatcataacgatgaattcaaggaaatcaaggattaaaaaaaagtataaatccttaatctccacctcttcaaaaaaatttatgaataaattgtacgatcatggtgcttcatccgactcattttctatattttctctgaagacttcccattctggtaaacatgaaaattccagatttgaaaagctgaggaagagaaaataccatgcttggggcaaatttgccgatatcaacgatttaccagttgaaataattgccaaaatactttctgaattcgagttaggtcgtgatcaaaagacactcgtaagatgtctatacgtatcgaagaagttttataaggcgacaaagatcgtcctttataggctaccttacttcacttccacttacagagtggcgcagtttgtcacctcactaagattacatccggataacggggcatacgtgaaagtattggacctatcacacttgaagccgggaattataggccaagactcgaaggattctcaaggcctagacgatgatggccactcaaggcgtcacagacgccgtcgccgcagatctactaacacaagtttgaatctacctccagctactccaacatctaccatttctaacgaggatgatgccaatagcggattaatcaaagacgacgcttcaaatggcagtgaagttgaagacttggcattagctggttggagagactggagatacagaaatgaacccctttatagctctcctctgttgaacagctttaaactgaaaaaagtggtttctcgttcttcttctatcacttctacatcttctggaaattccaccggtgttcactctacaaggagacaacgttccaatagttccgttgcttccataacgacgagtatcatgtcatccatctataacacctcccatgtctcattgtcttcaaccacgtctaataccagcaatggtaacatctcttctggtagtaatctgtcaagagtttccactgctggatcattgaaaaaagcttctgcgaagtccacaaggtcatctcctcagaaagcaaaacctatatctgacattacgtcatcttcctggtttagaatgaggttaagttcaagaaatagaaaggcaaggacagctaatacgattaatttaaagaactcgaaggataagtctgacgatgactttaaagttttaaagcacgattcggggcatccatccaattatcgttcttcgacattaaaatttagcattgaacaaccatttagtacgcatcatccgtatgccaacaaatttcttttaaagtacgctccttataaagatctgcccctaggttatattttacatatgctgaacctgtgtcctaaccttgttgaactaaacctttccaatttagttatttgtaccgatttcaaattaatcaaccaaagatccgaaagaagaaggatgacatcttcactgttgcccgctgtccaggagtctagtgtttctgcaggccctgagaaagatttagaaattgtctatatgaccgattctggcaaaggttatgaatattatgaggggttaagcaagaaacactcacgttcttcaagcctaggtaccaatccatctagttggattggaggtcaggcgaattggacagattacccacctccaatcgatgcacaaacgaaaacaagagaggaacacagacgcaacaataccttgaacaataagaacgtcgtattaaagaagctaaacccttttgaaatttttgaaatgatctgcaatagaaatgaagaaaaaggtggctactgctccttaactaaggtgaaaatgaatgacattgtgtggtgcaggcaatatatggtaaagtattttgtaatgaggagctggcgaaacgatttggattataaatccatggaaaacaactcttatgaaagacacttattcagtttccgggactctggcttggatagaaatttttcctgggcttgtaatgccaaattgcatgaatttgtcgcattgatggttatggatcatctttcaaatttagatgatttaggattagaagagctttttaatatcaagtccgaaaagctatatataaaaaactattgttgccgagacccggatattctcgaaatatcaaacttatttgatattagatatggggccggatctgaggctgatgctacttctgattccaatctcgaagcagaatctttacaattcaggttgacaatattaaaaacagaaaagccaacttcattttggctcacaaaagtttccaaagattatgtttctttagtggttaaattatgtgtggatgatgacattgatatggacaaaatgaaagttggaaaaccaactttgagaatagacagtattacacacaatttgattagtaggttaaaggagttgaggagagttgatctaaggagaaatgttggcgagaatagctactatgctggaagcatcatatgacgcctgctctcttttaacagcatacgttctgttaatttatttgaccaaatattattgatgtttatttttttcttttttgcatagcctttctacatttcatggctttatttatttatatttatttttcgtttcctatttttttgcatacatagacactacctttgatttttgcttgtaagatgtacgatataaagtatactatgaaaaatttgaaaatattggtcttagttactttttctggtttgttttatcaattcatgtagcagtgtgcacgaaaatctagttacgcaatgtgaaatctagaaaaccttctacaatttggaattatcaatcacctctcgttgaaagttttcacacaccaattctggacggtcgaagcataaattatgagaacagtcaggtaaaataatcactttacgaagacattctttatttatagtttgtttgtaaaattccaaattttcaataggagctataggatctttttcagcgccaaatattataattttctgtttcatatccgtttgcgtcaatacaccattgaatttaacccaatcaacagtttcccatcctagtaaataacctatgatggttctacttttgttgcttatgttgtttttaaattgccagaacttcctgtatttcaacttgacatcatcaccttgttgataaaaatactgcttgatgccggaactttgtagaccttttacctgatcgaatttgtttctataaacgtcaaatagccatggcaatttaaacacaccatagagagcccactggataatatgtttatccttagaaagctgctcgatatgtgctttggggggcgtcaacaaaactagcgtttgtaccgcttttgtatcagccatgtgctgctcgtaaagatgacatgccagaaaacaacccatagaatgccctacaagcactatcttatgaccgttaaatggatttacgttatcattattcggcaccgctgtagaccattttcttaagacgtcacatacaagaacgaaaataagttccaccactttcagcatggggtagtcgctccattctgaactatgaccaaagccgggcagatctaacgtcaaaaatgccttttgatcagagtccacaagctcgagtaagggttcaaattgttctaagttgccagccaacccaggcacgaagacgaaaacagtatcaccccgtatccctttatcgctcaagttgtgacacgtccttattcttgaatttcgatccgatagttgttcattaaaaaactcctcatgttctgcgataaacttcaacctaaagtccaaatctacctctggtttgcgaatgtaagctaccaaatcagctgcattttctgcattttgaacaatctcttctagcgtctttccagaaaggggctcacaggaccaactttttgttgcttctgcacgttctgccatattcattaccaagagaaaaagttctcggtttaaggctttcttctaacgttgagttacgatccaaatgcgactgtaccatcttggtagttctttattaatgaaccctttaaaattgccgggttaaaagaatggcgcgtcctcttgaaacttttcgaagaaaacaacgtaactgatggttaaaatttgcataaagaaggtcaggcctcgtctgcggacaacaacactatcaatatccagcgtgcaattatgtctgtgcaccacaaaaagaagctaatgcccaaatcggcattgctgattagaaaataccaaaagggaatcagatcatcattcattgggctcatcatagtgttatcctttttatttttcatgagtggctcaaggtccccagaggtaccaatagctcagggcaccagtgtcagtcgtgtagccagtaaggattatttgatgccgtttactgacaagtcacaaggagtaatccatcccgtggacgatggaaagaaggaaaagggtgttatggtcacattggccaggaattcagatttatggaacttggtaaaatctattagacatgttgaagacaggttcaataacagatatcactacgattgggtgttcttgaatgaccaaccatttagtgatgagtttaaacgtgttaccagtgcattggtttcaggcaaggcaaaatatgggacaatcccaaaggaccattggtccattccatcttggatcgatactgaaaaattcgatgagaaaaggcttgcaatgggaaaattggatattccatatggtagttccgtgccttaccgtcacatgtgccgtttccagtcagggttcatatggagacacccactactggaggagtacgaatggttttggagagtggataccgatatcactttattctgtgatattcagtatgacatattcaagtttttaaaagtaaataacaagaaatatggattcattctttcggtaagtgaatatgagcgcacaatcccaaccttgtgggaaacgacaaagaaattcatcaagaaaaatcctaaattcttacacaaaaataacctcatgaaattcatttcgaatgatgatggtgacacttataatatgtgtcatttctggaccaacttcgaaatcggctctttagacttcttcaggtccgatgcatacagagaatactttgattacttagacagttctggtggattcttctacgaaagatggggggatgcgccagtgcactccatcgctgcctctttgttcttggacaagtcagaaatccatttctttgacggtcttggattccatcatccagatttcacctcttgtcctatcgaacagaagattagactacaaaacaagtgtatctgcgaacctagcaaggacgtcacctggactcctgactacttctgtactagaaagtacttttcagcaggaaattacaagcttccaccaggaatttaaaaaccaaactacaaatagcgcctgctccgtcaaaacaggtgctaaaacgtcaacatgtatctatctatatacacataattcaatgtagtagccacctcacttcattctagtgccttcttgggttcaaaaatgggtgcggtgcggccggagatgaagagagaaaagcaaaattgtatctaaaccagcctacaaaaacacaaacttgatattataaagaatcaagcatcttactgaacttttgtcctctacagaaaagcgaaaaaactctaagaatagagaactagagtggtgttcatatttctagtcaccatggcgtttgaggattatttttctttccagatattcttcattttcttaaggaaatccttagaaattgttgtcattgtttctatcctgttgacgatcgtcaaacaagatctgtctgttgaggacgacagcccgtttgaaggaagttcctcttctgctggtcttccaagtccaaatacgaacacaaacgcagattcgaccactgccttcttacaagcagggccttcagacggtaatgctattggaacgtccgctacggctgctaataataaatcgaggccgctaaatgtggaggaagaagaagaaatttacgagtactctaatgagcttagagaccaggaccgcgagtccgatgaacatacggctgacaacgttaagctatatcagaaattaaaaatacaaattctagcgggcggcgcatttggtttgttgctgtgtatgttaatcgggggtgcgtttgttagtatcttttatcatattggaaccgacttatggacactgagtgaacattattatgaaggtgtcttaagtcttgtcgcgtccgttattatttctgtcatggggttgttttttttaagaatggggaagttaagagagaagttcagagtgaaattagcttctatcatttattcaaaggacaataatttgctgggaaacaaaacccaaaaaggtgtgaaattcagtcaaaagtactccttcttcatattaccatttataacgactttgagagaagggttagaagctgtgtattcaattggaggtatcggtattgaccaaccactatcctcgattcccctctctatggtccttgctactgcaatcagtacggtgttcggtatttttttcttcaggtactcaagttctctttcacttaagatatgccttgtagtcgccacctgcttcctctacttgatcgcggctggtttgttttccaaaggtgtatggcaacttgaattgcaagactacgtcaacaaatgtaacggtcaagacatgagtgaagtagaaaatggacccggttcgtacgacatatctcgttctgtttggcatgttaattgttgcaatggtgaaaaagatggaggttggatgatttttactgccatttttggttggacgaatagtgctaccgtcggctctgtaattagctacaacgcctactggttggtattaaaatacgctttgaagcttctaatgatagaaggaaaatgcggatatatcccatatctacctattagctggcaaaagaaacgtattatgaaaagattaagcattgccaaggcatcgctcgatctcaaacatcatacttctgaactcaactctagcacatcagagccagacagtcaaagacggtccaaagatagttctgtgcccctaataattgatagcagtggttcagcaaattgagaacataacaaacacacgtaataattttaagcttcttttcatacattttacagtaaatactatgtacatatatattcgtcattaaaaatagctagaaaaaggcatgctataaagactaaatgagtgctcctttgattttagatgccaacaaaaggtaattcatgccaatgtctctatgacggccactatgtcaccagaatcaaccatatcaccattgccatggcaaatcttgataatcttacccgatttaggagcggatataatcatttccgctttcatggcttcaataattagtagcccttgacctgcttcaataacatctccaacagatgctatggatttccaaaaacgcccagaatactcagaatatacaatttctgcaccttctgggaagtcttcttcctcgtcaggtttgactgtgacactttcttttagttcagagtttgcattttgaatcaatttggcaaattcctctgctctttcaccaagctggccctcctggaatgctgtgatggaatctttgtttgcgttgatccatctcaagtattcttgatgatcaaaaacactcttttcgatattgactttataaacaccattatcacaatcttcagtcattttatccaaatcttcttcagaaactgggtaaaattcgacttggtcaaatgggttcatcaaccacggaacctcagaagatgcggccagacatagtttgtcccaaattggtattgttctacccactaattggtacccaccaggactgttagcagcatatatgcacatatacataccgccaataccgactgcacctctttctgtatatgttctacttgggttgtacttgcttcccaaaaatctgtgacgaggatctaatggaacagcacaaggcgaccctaggaagacatcacctaaacctaaaaccataaatctggcagaatacaacatatcataaacttcattccttgaaattccatttacattggcaatgaaatcaacgttatttggcaaccatggagcagacgaacgaattgtttcttgatacctttgaacacatgccaaagtcttcgagtcttcgaaagccatcggtaatcttattatattagaagttatcttccaattttcatcaaactggatttctgtttcatatgccaccaatactttaagcaattctttttgagtgactttgtaaccatcaaattctatcaatacagatctaacaccttgggacatttcaacaataccaatagtcttattctttttcacaagggagatcaggcattcaattctataggaaatattaaaattcatttcattatcaccgtattccaccaaaacataacgatcacctgcttgtctgtatacaacctttggtgaaagctcattcactttttccatttgtgcaagaataggcgtttcgaatgatggtaaaattgaaacagagtctaagcgccttaacttagtaccatccaatgatttaattgcaacatcctgagattcctttaaggatctcgagctttcgtaagaaagtggcacaaactgaatggaatcaccgggtttaacctgtccaaccttccacagttctgcttctgggacaacagcttgacacacaaaaccacctaaggaaggaccatcgcaagtaataataactggctcatcacccgtgaaattaattgcacccagagaataaacgtaatcgtgagtgtttgaaggatgcataccaccttcaccaccattacttcttgcccacttaggtttaggtccaatcaaacggacaccaaatctattggagttgtaatgaaccttccacttctcactgaaaaattcttcgatggactcaggtttaaaaaaatctggagacccatggggaccacatgttacaccaattctccattccttagtttcggaaatttgaggaattaatgattgaggaatattctgtggaaggcactcaactgatttattttcttcattgcttggtaagaatagtacgtctccaagttttagcacccttccattgtatccaccgacatttcctagagtgaaagtagaataagagcccaagtatttaggcacatcaatgccacccctgatacctaagtatgctctacagccgcttgtcaacttgccaatggataaagtagatcccctcttaacttcgaccggtttgtgttggggaatttcttggccgtctaatgtacatagagcggtaccaccagtaatggcaatgacagtttcacaatggaaaacgatggatggaccagtcaacgttacttcaatggcaggagtcctgtagtcattaccaacaattctgttcgccaatctaaacgaatatgcgtccattggaccagagggcggaacaccaattctccagtacccaactctaccggggtaatcctgaatactagtgtgtgcaccgggcaaagtaatttcgatggcggtaggctcatattgataagagttcaaaatgtttgtagaaacttttgctttagcaaagaaatcactggtaatgatagacttcaggtagtcaatgttagtaatacatccgtaaacttttgtttcttctaacgcttgatttaacttggaaattgcatcatcacggtctttcccatgaacgataattttggccaatgttggatcatattcgggagaaatattagtacctttcttaacccaagtatccactcttgcccaatcaggaaatttcacatcgacaagtaaacctggagaaggtctgaaatttttcaatggattttcagcatataaacgtgcctccattgaaaccccattgacttctacctttgtagaatcaaaatcaggtgcatcattagcggcaatcctgatcatccactcgaccaagtctaaccctgtaaccatttctgttattggatgttcaacttgtaatcttgtattaacttctaaaaagtaaaactcgtcctttttctcatcgtaaataaattcaaccgtaccagcacacttgtaattcaataaagatcccaaactttcagctgcctttcttaacgccaacctcgtcttttctggcaaatttggtgcaggagtttcttcgataactttttggttacgacgctgtaaagaacaatcacgttcgcccaaagcaatggccttaccaaaaccatctcccataagttggacttcaacatgcctggcattttcgataaaccgttccagaaatacaccagcgtcaccgaaaaatgtttcaccttgatgtttcacagtctcaaaaatatgctcgatgtcctcttcagaatcgactttctgcaaaccaataccaccgccaccagcagttgacttcaccataactgggtattccaattccgctgcgactttcttagcctcttcaactgatgtgataagcaaagagcctggcactagaggaacgccagccttctgtgcaatctgtctagcagaatgttttaaccctaaacctctgataatatctcccgaaggaccaacaaaggtaatgccagcactggtgcacgcatcagaaaaatccgcattttccgacaagaaaccataaccaggaataatggcctgtgcattagtttgcttagcggcatctatgatcttattcatgtctaaataagtttgggctgcggttgtgccatgaaggggtacagaaacatctgcatcagtaacgtgttgagaatatttatcagggtcggaataaactgcaactgatctaatacccaatttttttaatgtcttgataatacgaacggcaatttcacctctattggcaattaacacggtatcaaataacttcttcttttgggactcttttttcttcaacatttcaaaatatgctctaaatccaccatactttgtgatatcaactgtacctttggctttgtaaccagattcttcacaaataaaggatttgatccattcaccagattctaactccactgaacctattcctaatggttcaggaaccatggaaataaaagcaccgaacagttcttttggaacactgtacacttctaattcgatttgagagccattgctatcttgaactcttctcaaaccaggttttaaaactggtccatttttgggcaaagcaaaaagctggtaagcttttgatgtttttgttgtacataaatatgttgcattgaccttttccaattgccaatgtagaggcagacccttaagatgtgcaccgacaacagccaattttatggacgtagatgggtcatagtctggtcccactaattgatcgtttgctggctttactgaagaagaggtaaaagtaccgtatgttctggaaccgttggggaatatattttggaaatagcggttagccaactctaatagtgcgtaatctgtgaattttttaccgattaaagtaataccatttggcaaaccatcgtctcggaaccctgcgggaacagcaagggctgccaaatctgccaagttgacaaaattagtccatgtgccttgtcttgaattgactaggactggttcatccgcaacttgttgcatagtaggatttaaaggacatgtgggcacacacaatacatcgactgattcgagaagtcgtctcactttttgcaagatgccttgtcttttgtattcaaaactgaagcagtctactgcactgtatttcttggccccttctataattgaaataacagtagggtccaaagattcctttggtggtttactgtccaaaaacgattgaatagcttgataacgctcggccacccaagtaccttcgtataaacagcgagctaactctaaaagaggctcaaaatcaatttctatgacgttagcgcccgttcttgatagattttcgacagcattggaaaacagtacaggattcttggtttcaccataccatgggatatttttaggaatagcaatcgttacattgcttgaaaattttttcaaagggttggaaacatagggtctagaatattcatcattatcaggatctggctggcacatgatgcggaagcagcgttcagcatcacttaggtttaatgcaaagatggagacgcagtctaaagatttacaagcgggaactacaccttgacaggaaaagacgccctttgttggctttaggccaatcaggttgttcaaggcggctgggactctaccagaacctgctgtatcagtacccaatgcaattggtacgatacctctggcgaccaccgatgctgacccagcggaggaaccaccagatacatgctctttgctaaaagcgcaaggtgttttcccatatggagaccgtgtgccgactaatcctgtggcaaattggtccaagtttgtcttacccacgattatcgcacctgcatttcttagtagttctactactttagagtctttggaaggctcatatgcaaaggatggacatgcagcggtggtgggtagacctctaacgtcgatgttgtccttaacagcaatagggacaccgtagagaggtagagtttctttattttctctgctctttaaaatttggaattggtgcagtaaattttcctttgaaattagcgatatccacgcattatcgactggcgcaacattttgagagtctagtagtgattcaagaagccttagtgaagcctgggagcttgatgacttgtggaaatcaatccagtcttggattgaccaacctaacgatatttcagcagttgtatcggaactaactgtcattttttaatcaaaactgaaatttattgtgactataaaaaagatatttctattttttatcttttatattaatgtaaattgaaatttggtgtatatcagctgctccactgatatattaatataagcttataaaaacttgagcctatatgatcctagaaaaaaaaagcttagctaagagagcctgatattcagaagtgagcgagtatacaaatctcacacctcatctgctctagtgtttaaatacaaacattcaatttccaacaacgtctaacaaagctcgattcaaattaagaagcaggaaaaagcaaaacatctgcgtgtcttatctcaatggcttgcgctaactgcgaacagagtgccctatgaaataggggaatgaacgcatattggtttcattatagagcgtcaatcaagaaagaggcaccaaactataaacgcacatttctcggtagggctaggaacgctttcctgcttatcttatctgaagcttatttattgttcgtttttttatcttatctgataaggggaaaaagcctggaaaagcgcgtaaatgatgaggcgaaatgcagccaaagatgcgtgccgttgcagttagctaacaacctggcgttcggcgatcgccataagagatctgccaattttaaaaagggtattgccaatacacatagtagccttatctgcagcaagccataggactaatgtgttcgacgtcgttggggaaaaaaagcaaagaacatgttgcctttgaggagactgcagcaagaaaaaaagttcaataaggattgcaaaaaaaaaaagaagctcgcactcaggatcgaactaaggaccaacagatttgcaatctgctgcgctaccactgcgccatacgagctttctattacatgtgggaagactaatatagatagtatagtcaattatacgaagtagtgccagccccacatataagagaacggtggaatatttgaactgtatgcaaagaagtttcagcggggacctttattttagaaaaagcgaataaatgtcgctcatttgtttaaacggtatttgttggactgagggttgcttccatacggaaatgctaacgaagaggatgtgctgaattttgctatgtttggaatgggctcctccatctgggaatgataatcatttttattattgtgtgttcaaatacacttacacatctgttttttcgtggtaaggaatccgagaatcacatgaggtttgggatagttgctggcaatcaatgaatgacatcagataaaacgaaaggagaaataatatgttgataattagaggttaaaaattagtattaatgaagaaataattactgatcttcttatactaaataagagaggtatataaaacacacgccgattggtcatattaatcatgaccaatataatagtgattccggtagttactatacattgatgtgacgactcatattcctcatatatgtacctaccataacatgttcaactaataggtctttaacacagcttcagtattgtctgagcttctcgtttaacattccttctgcaataggcgcaatcacacttaaacgtatacgagttgtacattaatatacgatgtaagcattgaattgttaccatagcaactcatgtcactattaattactctcgttccaacataatattattatggagtaatatctattccctttcgtggattccaagattctcgaggtatatttccagtatattttgtatacctgatattatagcctttagcaacaacgaaatcaacatttatctcaaatttcacctgtttctcatttttaagcgcctagcccatctaatcatcttaactattcatcagggaaaattaatatacattgtgctcttaatgtttcgaaaaataatcaaaatcaatagaaatagcgttttgctactaacaaagccctttgatccaaagttggcttctgagaacttaacatttcagtagaacaagcctcaagcttaaatgaagaatggcaaagtaaatgagacctctctctccatattttgctcagagcctgttaaggaaaacaacaccgcacattagtgtgaaaaactttccccgcaagctgttggaagatgaatcatttattatcttttgactgttagctacattactagctgttatcaatctctcagacgattatatgaatattgagatagttgttgggattaacttattgttagaggctatagcatcagatatacaaaataaaataaaaagttctcctccaagatatagtgtaatcgatatttcgatgtaatgccatcattatttcttctattttatgtattcctattgtcctctaacattgtatctgataatattctagtaataggattaccatcactaaatgatagttaattctcattccaaaaccgactcctgtcaatattgaggacccatttattccaacggtccaaatccccaatattccctgctcggcaagaagttagaaaacatatctttcgtgctcttgcaggcttgctgtattatcataaccgaaggatgaccaactttgatcaccccaggtggcaaaaacataatacatggtggtggtgtcgttgtaaaaatcatcttctttgggtgtgtataggatcccatccaacacacgtgttaaaatgacatcaggtatcaatgctaatccgtcgtcactgacaataagctgagttgacatcacctgatgatgtgaaatagtagcaagagaactagggtaaggttcatgctggttgttttcctatgatgaccaacctttggaattgggtaattctaggtgtagcctgctagccatcaaacgagacctttcaaaatcttcagtcattacattttcttctgtaaatagggaaaaaagcctttagctaggattgttcggcaatagaaagccctccagtttaaacttgacatagaaaatctttaaggttaaatcaaacataagttattatccgatatagtgtaacggctatcacatcacgctttcaccgtggagaccggggttcgactccccgtatcggagttattttttgtttctataccattatttttcttgaatgttgcattatgatagtatagttttgctatacaaacttcaattctcaaaacacagtacgtctagctcactactactctctctaattcaaaatcgttcacttctatcgaaagctgtgataatttggaaatattgtcgtgggccacgaatgatttttcaattacattgctaaatacgaagacattaatacctttattcatataagcactttcattatcattttttactaaagataaaactaactgcaggcaccaagaagttcgaagccaagagtaaagatgtcaggaaccggattatcgctattcgtgacgggtcttatactgaattgtttgaattccatttgccagatatactttactatattatatggtgatcttgaagcagactatatcaactcaatcgaactgtgtaagagggtgaataggttgagtgtaccagaggcaattctacaagctttcatttctgcattgtttctttttaacgggtactggttcgtatttctcttgaatgtccctgttctagcatataacgcaagtaaagtctacaagaaaacacatctactggacgccacggatattttcagaaaattgggtagatgcaaaattgaatgctttttaaaattgggattttaccttctcatattctttttctacttctacagaatggtcacagcgttacttgaaaatgatgcaaatttgataagctaatagcgacaacaggaaaaaaaaagagagatttgtgcatatctatgaagtatgtctaccacataaaaatgaccttataacacaacttccttagtatggaagtaatacatatatacatatatacatatatacatacatatatatatatatatatatatatatacatcttttgaaccaattccctatagacttggttgtaattcgttagaaagattttcattaattttatttatctttttcagaagtccgttatatggatccatcaagtctacgaaatgtgcaatatccagaatatttgagtcatcccgtattgaatcgtcctcgctatcttggctcataattttgcgatctccctcgtatttgcctagcaaagtagaagtcaaatcatttagcctcttatttagcttcactttgtcgttcagtttggcttgttcattttgtaagtcatgccagtctttaccggctttcaactcttgaatttcatttcgtaccgatattatctgctggttcaaatcttcttttcgagcaagtacctgcttcagttggtagcagagctcattattcgacacgttgatatctaatatgtctttcaagtctctggtcatttggtctgatatcgtttgaaagagtcgcagatctaatttgtacaatagtttcctaaattgatcatcatcacttttattgaaatccttcaaagcttgcggaatcaaatcattttcaaataagtttatgaataaagaagataaaacatcaattgtggtcacagaagtgatagacgatgatagctgtctaatgggtatatcatcgaaattgtaacgagtagtaaggtcttcatcatttctaacattttgcggcgattcgcttataagacttttattttcagagtcgatcatgggatagtcttctgcatccaagggctgatacccatgttcatgacggtcctgcgcatttacgttattagtggtaataggaaactcgaaagaattcgcaagttttggtgaagacaaaatgggttgaacaggagattgaataggtgagttctcctctctataaacagcatttggcgtcttaaatacaataacatcatcatctatatcgtctgtccttcttgaatgactgcccctcagcctaaaagctaatttagtgtctctatccatactgaggtttttctttaaatgaacacgcaaatagtcaagacaatacagagcaacacaggacacgtaaaaaaatgagagcaatcgcttcttatactgcaacgatgttgacccttgccataatagctaatgaaatcaatcattatcatttctactagtcctttaacaatatttggatacaccattaaatttctccgtacaacacgataaaatattttctaccagcttcaaacggctgtgaaggggcgatagtgccgttccaaaaagcgttccccaaacttgtattcaagaccaaatcttagtcaagcaagcagtttcgcaccttcatacactccattaaaagtgaaaataagcatatttgtaattaaatctggttatcataccctgttccctttagaaccaatatacatagacgcagtcgacaaagaagcaataaaagagattaccattcttattcactatttttttttttctctgactcttcatagttgtacggaaaaccatctgcgtgttatatcctagttccaaatattctgatttctcgtgatcgaatctgttatattgtcatatattgtaattccatttttttcccggttcattttttgatattctcttcctgttccaatattaataaaggaggcttttttctttccctttcgttctgatttatattgtttttactattattggatcttttaaatattacagctttttcatatccttcgccatcgatttttgcctgaaaaatttacacaaatgatgtctaacgttgctaacgcctcccaaagacaggaaaatccatatattattccattgcctccttcatccacagtggaaacttctactgaacccccaagaacgttatggatgggagatttggatccgtccttcgacgaggccacgattgaggagatatggtcaaaactggataaaaaagttatcgttaaactaattagagccaaaaaaaatttgttgattccttgtagctccacctcaagtagtaataacaacacaagtgaggagaatgctgaaaaccagcaatctgcatcaaacagcactgatcagttagataattcccaaatgattaatattaatggaatatccttcattgatccttccactactcaattacatcatgccggatactgttttgtcgaatttgaaactcaaaaggacgctaaatttgccctgtcattaaatgctacacctttacctaatttttattccccaacaactaactcccaaactaatccaacgttcaaaaggactttcagattgaattgggcgtctggagctactttacaaagttctataccatctaccccagaattttccttgtttgttggtgatctttctcccaccgccactgaagctgatttgttatctcttttccaaacgaggttcaaatctgttaaaaccgtccgcgtgatgactgaccctttaacaggatcatctcgttgttttggatttgtcagattcggtgatgaagatgagcgccgcagggcactgattgagatgagtgggaaatggtttcaaggaagggccttaagagtcgcttatgccacgccaagaaataatatgatgctgcagttacaggaacaacaacaacagcaacaacaattgcagcaacagcatcagcagctagatcaggaggataataatggccctctcttgattaagactgcaaataatctcattcaaaacaatagcaacatgcttcctctcaatgccttgcataacgcgcctccaatgcatttgaatgagggcggcatttcaaacatgcgtgtaaatgattcactaccttcaaacacctataatacagaccccactaatactactgtttttgtgggaggactggtaccaaaaactaccgaatttcaattacgttcactattcaaaccctttggacccattctaaatgtcaggattcccaatggtaaaaactgtgggtttgttaaattcgagaagaggattgatgctgaagcttcaatacaaggcctgcaaggctttattgtgggcggcagtccaataagattatcatggggacgcccatccagttcaaatgctaaaacaaattcgaccatcatgggggcaagccaatatatgtcctcaaatggcctgagagcgccatctgcggcttcttcagtcgataactccaaacaaattcttgaacaatatgcggaagataaaaggcgactctttttacatcagcagcagcagcagcagcagcagcagcaacaggatggtaacttttctatggagcaaatggcgcacaacaactattacaactacaataattacgattatcacaggaacaagaatggcagccatagcgacctcgttaatctgcagagatctaatgtcccgtatatgcaagaagacggtgcactgtacccacaccaatattcaagtccctcatactcgctccatccgacgggcaaccaattctccaatgctactaataacttacctcaatttgggaacgcgatgtcaatttctatgcaactgcccaatggcaacagcaataaaacggcctcaagcatgaacacaaaccctaacacaaacatgatcatgaattctaacatgaacatgaacatgaacgtaaatccagtaccatacggaatgggaaacggtgcaaatatgtatgacgtgtccaggatgatgactcctcccttaaatatagccccgaattccaataattcgaaatcgagcatcatgaacaagcatcctaataggaacaatgttccgccaattcatccttctcttctacattgattacaaaagacaaaaaaagaaaattttaatcttgtccgcagttttatctgcgtctctacgttcttacgtttcttctattaatgccatttcagttacaacctagtcaattgtcgatccataattctaatcaaatttgtttttcctctatactacctatctatttttatctatctaagtacatttatttactcaaacagttccgtttcaaagtgttttatattaactatatatgcgaaaagctggcgtcataatttcacgtgttataatagccatgctgacggaaaaaaaatgtgaaaatcgctacaaagtccgatgactacgggcagtagcatgtaaatgatggacacacacacacacatatatatatatatacatttacttcaataaaaggctgtgccagacatttttgccatacattgttcatgaagtgtgcaaaataagagagtgtataataggataaaaaatggtcaaatcgctacagctagcccatcaattaaaagacaagaaaatactactaatcggaggcggagaagtcggcttgacaaggttatataagctgatacctacaggttgcaagctgactttagtatctcctgacctacacaaatccattattccgaagtttggaaaattcatccagaacgaggatcagcccgactacagagaagacgctaaacgctttatcaatccgaactgggaccccacgaagaatgaaatttacgagtacatccgcagtgacttcaaagacgaatacctcgacctagaagacgagaacgacgcgtggtacataataatgacctgtatacccgaccaccctgaaagcgcaagaatatatcacctttgtaaggaaagattcggtaagcagcagctggtcaatgtggcggacaaacctgatctctgtgacttttatttcggcgccaacctggagataggagaccgtctacagattctgatctctaccaacggcctttctccgcgctttggcgctctagtaagagatgagatccgtaacttattcacacaaatgggggatctggcgctggaggacgctgtcgtcaaactaggtgagctgagaagaggaattaggctgctggcaccagacgacaaggatgtcaagtaccgcatggattgggccagacgctgcacagacctcttcggcattcagcactgccacaacatcgacgtaaaacgtctgctggatcttttcaaggtcatgtttcaagaacagaactgttccttgcagttccctcccagagaacggttgcttagcgagtactgctcgtcttgagcgacagggcctcctcttttaaggggcgcgtcctttctattgtgtagagaaaatctactgggattttgtatatatttcgcatatataggggttggagaacgaacaacaatgcctgttcagatcaacttttcttctatcttatcaggcaagatcaggcacacaacccaactataataactataaacacttatagaacaattaccgtttcttccttcacacaacatggcttctacttcgaacacgttccctccaagccaaagcaattcttccaacaaccttccaacttctagacatgcatccattgtggagatgctgtctactccgccattgctgccccacgttcaagtgaacgatacagacgacaaggaacaaccagaagagtccacgccgccaacagcaacagcggcagcgcctggtccaggttgtgctgctacacccgcccccttgcgcgatgaaaagcctcaattcaaactatcagctgttcctatgacccagacgccatcgcagtgtctgtcatgtgtgcacgcccaaaaatggcaacacataccgttgtcgcaattgatcgaacagaataagcttatttttgttccaggttccatatcggtagaggaggcattcaacactttgatcaagtatcatctaaactctattcccgtggaatctttccccggcgacatgaactgttttactttcgactacaatgaccttaattcgtaccttttgctggttttgaataaaatcaccgtcagcaacaaacagcttactgcagattgccagaatggaaaacccgtaccagtgggcgaaatggtgaaactaactcctaagaatccgttctataagctgccggagaatgagagtttgtccacggtgatggggattctcggttcgggtgtccatcgtgtagcgataacaaacgaagagatgaccaaagttaaaggtattttgtcccaacgtcgtttgataaagtatctttgggacaacgctagatcttttacaagcttagaacctctattaaactcctcattacaagatttgcacatcggtgttctcaatattcaatctaagccaacttcaagacaatcccgtgtcatctctattcaaggcgaggagcccttaatcatgggcctttataaaatgcatgtggaaagaatttcttccattgcagtcatcgacaaacaaggtaatttgctaggtaacatatcggtaacggacgtaaaacatgtcacaagaacctcccaataccccttactacataagacatgtcgccatttcatttctgtcattttaaactccagaggattagaaacgggtaaagattctttccccatttttcacgtataccccagtagttcactagcaaggactcttgccaagttagttgctacaaagtctcatagactatggatcgtacaaccgccggagtcgtcaacctcggcgtcatccacaaatttaacagctgctaatactgcagccaatgcagtttctgccaccgctcaatcgtctgctaatggtgcgactccaatgtcaaagtcatcctcttcaacatccctcaactcccactctccgttgatgacagcaatggaagacccaccatccccacgttcttcggccatcgcgatcccaccaccaagtcccgcttcctcaacaaacacaccaaacctattcgaaaaggaatatagaacgggtaagttgatcggtgtggtctcattgacagacatcatcaacttattagcaaggaaacaaacagggaataaagaagtggatccgcaatccgcaagaagacagagaggcagtatcgccatgtgaggcttgcagcgttgtcttttcccgctgtttccctctccctcaaaaaaaaaaatcttttacaatgactaaaagaaaatattgttcatttatatggttttaagtattttgtagacatttaagcgtatatacttgttctgaaaacatttatatattctattttgtatattcaacttattaaactctgacttttgctattgtcgcgtatatgtatatctttttttcttgtcgtggaaaattaaagcaaaatatgtcaggcgaatgtacacacaatgcagaaactgatgcggttaattttgcattctgaaacgatttaaacgaacagcattaacctccacgaccatattcaaacgattggaaatggaccaaaaaggtatgttctggctttattttcaattatccgcccttcgttaggggtgttttagatcattttgattaacaattctatttatgatagcaattgtccttgataactctaaaagtggtagtaaacagacaaaatcgagtggcaaaatgcaaacgcaaacagatactaatgctgaagttctaaacaccgataacagtatcaaaaaagaaacaggaagtgattctgaggatcttttcaataaattttcaaacaaaaaaacgaacaggaaaatacccaacatcgctgaagaattagcgaaaaacagaaactacgtaaaaggtgcgtctccgtctcccattataatttctggttcctcttcaacttctccatcaggaccctcttcctccagtacaaacccgatggggataccaacgaatcgatttaataaaaatactgtagaactatatcagcattcaccatcccccgtgatgactactaacaagactgatacagaggaaaagagacaaaacaatagaaatatggataataaaaacaccccagaaagaggatcttcttcctttgctgctaagcaactaaaaatatcatccttgttaactatatcctccaatgaagatagtaaaactttgcatataaacgatactaatggcaacaaaaatagtaatgccgccagtaataatattccatcggcttatgcagaactccatacagagggaaatagcattgaatcactaataaaacccccaagctctcccagaaataaatctctaacgcccaaagttatcttgccaacacagaatatggatggtacaattgcaaaggatcctcatttaggtgataatacaccaggaatactcatagcaaaaactagttctcccgtaaatttggatgttgaaagcactgcacaatctctgggaaaatttaacaagtccactaattctttgaaagctgccctaacaaaagctcctgcagaaaaggtctctttaaaacgtagcattagttcagttacaaacagtgattctaatattagctccagcaaaaagcctacgtctgaaaaagctaaaaaatcaagttcagcatcagcaatactaccaaagccaacaacgaccaagacatcaaaaaaagctgctagcaatagtagcgattctaccagaaaaaaaaacgcctcgaacaagactacatcagccataaagaaagagtcaaatgccggctccaaattgaacactgttaagaaggaaaatagctctttatcttctatcaaagccactgagaaagaaaaagataaaggtggaaatagcacggaagcaaaaaactctaccagcaacgttagaaaggaaccaactgcaaaatccccaaaaaggttagtagccgcaccgacagtcagtccaccaaaaattctacaaacggcagaaaccaaagcaaaggaaccctcgatattgattgacgttccattgtatcaagctgatacaaacgactacctagacgaaaacggtcaggttatttttaatttatcaactttaataaaagagaagtatcacccgaaaagtaaagaactagcacaacttaaagactctaaaagaaatttattaatgcaattatccgatcattctaacggctcactagaaaaggaaaaagatgaagaaggagatgtaatagaacttgatgatgatgaggatatggaagaagatgaaggggaaatagatacagaaactaatactgtaactaccaccatctctccgaagaagaagtcgcatcctatgaaaggtaaaaatttgattggtaaatatgacgttgaagatccgttcattgatgattcggagttattgtgggaggaacagcgtgctgccaccaaggacggtttttttgtttactttggtccattaatcgaaaaaggtcactatgcaagtttggagcgtgcaaatggtaccatgaaaagaggtggtgttaaaaataaataagcattgtgtcagagattttccaaaatccctgaacgacataaaaaatgaaataaagtgtgcctatatctgaaagtatatagtcagtttatatgaagatttttccgagcgaatgcttttctatccatgtatctatgtccgataatatggtgaaagaaaaaatagataatttcaccttagagaatctataaacttggctataaaaccagaaacgagtatggcatgttcaatatcttggtggaaatgaaatagataagaacttcattttataccagtaaaatagtcatttagagattcgtttttatccacaatttccttatacttcggaagtttatcaggttcgactgacttcaaattagaatcaatcttcgaacaaacaatcttcagtagatcttcatcccatgttttttttagcacaatgaaaatattcaagtaagttagcagtaataatatatcactcttcttggcatctgccgtaaatgaatcttggatagtctgcagacaacagtcatgaacagctttcattttggaagaatctagttggatataatgtctgatgttactttgctgagctttgttactatcattgaccttcagtttggataatttttcgacaatcaaatccgtctcagaatcgttatccttggtggagatgcgtcgccttgaaaggtctttaaaaacacataatacggacgtcttagccaatggaaggggagatgtcttaagcacatctaagataaactcaaatgcaactttttcaggtattaaacatagtaatctggtgagaagagtgaaagttatcattcttaactgctgattgacctgaatacagttcttttgaagtagaacatgcaataatgtttttgtaacaaacactgaaagattcttcaattctttttttacatcctccaagggctcggttgtaatagcataccatagccagtagcgactaactgattcaactgctacattatagtaaactttagaatataatgatggagttgtaaatctcaagtagagataaatggcatccgttatattcatttcctttactaaatgttgattggtttccaaatagtggataccagaaaataatattacaccattatagtccaaaccaacatttttttctttagcggccttttgtacttcgaatgtataagccaatttatataccattctttccaaaaccaactttgcttcatcattaacagcggaaatctcctggggtacagacttataaataatcctacattcttttatcacattctgaaattctccctctatatcaacatcaagcgagaacgccatttggtaatacctgcaaaatagctcaagatattcggtgtaatatgcagataattcaaacttctgttgatttagtgcacaatagtatttcacgtcggcattggtggtgacagtttttatgggtgtcgaaataccaaaagtacaaagcctacgcaatagtctaacctgtaattcactttcttcctccacaactttatcaaacatctctcgagtaaaatcttcgttcaattgtatatcttttggtggatcagggggaatatagttcctgcagaatgtgtacaccctacgaagaaggaaaagggcatcttcaaaagtgtccgcatgactatacacaaatttctcaattgttgacacagcagctcccagatatttcgaaggaaacagagtagaaatccttttcagactcgcccctatgaattcaaataaaatgtaggatttcaacttcaagaaaaattcatttgaactcttgctttcaccgtaggatggaaaatcttttcgattagaggaattttcgattactccttcaggaggtaacgtattggcctttttatcaacaaagtcttccttattctgttgatcactcttggaaaaatcttttgaacaaagggatgaaagcaactccaacccagtaattaaacattttttgggctcgccttggattgagatggcatagaaacacttcattacaccttggacaatcatattcgtacctagtcttccatttacatcgacattatcctttgacaagaacttcaataatcccttaggcagatcccaaccgatttcaccagtagtactcggattatcctctaacaatgtattcaaagtttcaatgaatctcgtcttttcttcatagctcccctcttggttaacttgctcgccatatatatcaatcaatgttaccaactcaagaagatcctccttctgagttttgaacgcatcagtaacctcaaaaagtatgtcatcaattggttccattagtgtctgagtatcgtattgaatgtctagggtgattttctttttcagtgtttatttgttaataatgttcaccggcaattagtctttatttttttcctttacattgtcaaatttaaagaatcgtacttatgaaggatgcccgcttagtgtttgacagaaagctacttgagctgaagaaataaacgtacatccctaactgtatattctacagtagagtgaaccaatgacagtatgagtaggatcctagagagcgaaaatgaaacagaaagtgacgaaagctccatcatatccacaaataatggaacggcaatggaaagatccagaaataatcaagaattaagatcatctcctcataccgttcaaaatagattggaactttttagcaggagattgtctcagcttggtttggcgagtgacatttctgtcgaccagcaagttgaagattcctctagtggcacttatgaacaggaagagacaatcaaaacgaatgcacaaacaagcaaacaaaaaagccataaagacgaaaaaaacatacaaaagatacagataaaatttcagcccattggttctattgggcagttaaaaccatctgtttgtaaaatatcaatgtcacagtcttttgcaatggttattttatttcttaagagacggctgaaaatggaccatgtttattgttatataaataattcgtttgcgccaagtccgcagcaaaatattggtgaactttggatgcaattcaagactaatgatgagcttattgtaagttattgtgcatccgtagcgtttggttaaatacccgggcgctggaatggtctaagaagaaaacctacagtcgatcaaaaatcccgtacgatattaaatagagtagttaacgtacttgagcgttataaactcacattttcactcaagaagaaaatggagaatggagacatggtaagtgaaagcattaaggaagaaacacagttagcacgtatttcatcgaaagtgtttgattactttctatttggcatttaaatatacatgggaacataactagataaaatatacgccatatatagtacagctagtattttcagatgtcataaaatataattaacgagtaaaaattactttttttgggatgggggtagggtttcttcttctaggacaaccaacaaatctgatgcgtcaacactttcaccatccttaatgaaaacgtctttaacttgaccatctgctggtgaagagacaaccatttccattttcatggcactcaaaacagcaatcgattcgccctttttcaccaaagaccctttatgtactttaacttctatgataacaccagccattggtgcaccgatttggtgagtatcgtggacatcagcctttggtttagcaacagattgtatgttttgtgacttgtctgcaactctgatctttcttaattcaccgttcaattcaaaatacacttctctttgcccagttttcttatttaagtcaccaacagcttgcaatttgataatcaaagtcttaccttgttcgatggtgacttcgatttcttcatcaggttctgctggtgctaggaaatttttggttggtagaactgataaatcaccgtatgtttctctgatcttttggaaatcttcatagacccttggatacatattgtaagaagcaacatcgcattcatcaatatcaccgaatctgttctgcaagtcttctctaattttttcgagatcaaatggttctaattctaaacctggacggcacgtcaactttcttctcttgtttctcaatacatcagatcttaatggttctgggaacccaccgtatggttgaccaattaaaccttcaaaaaagtccataacagagtcaggaaagtccaaagaattagctaaacgtctaatatcgtcggaagtcagtttgttagaaaccatgaattgagctaaatcaccgacaaccttagaagttggggtaactttaacaatatctcccagtaggtaattggcttctctgtaagctcttttagtttcagcccattgttcaccaagacccagttgttgagcttggaataacaagttagtcaattgaccacctgggatttcatgttggtaaacttctggatctggtcccttcaagtcggcctcgaaacaagaatacaacagtctcatttcggcccagtatgcatctaattcacgaacatgctcaacgttaatcccagtatcaatgttaccttctaatgaagccaacagtgcattaattgatggttgggaagttaagcccgacattgaattgatagctacatcgacaacatcagcacctgctagggcacatgcagtcatagacgcaacagcagtacctgcggagtcatgactgtgaacatgaattggtaaatccggatatctggttcttagggagccaattaataatttggcagcggccggtttcatagtacctgccatatccttaatacccaagatatgtgtacccatttgaactattttttcaacaacttctaggtagtagtctaagttgtatttcttacctggctgaagcatgtcaccagagtaacaaacagtagcttcgacaacaccaccggccttcttgacagcattcacaccaacttttaattgttctaaatcattcaaggcatcaaaaactctaaatatatcaacaccattatccttggcttgcttgacaaaatggtcaatagcattgtcaggtaatgaagagtaagccacaccgttggcaccacgtaataacatttggaatggaatattaggcaccagagatcttaattttctcagacgttcccatggatcctcatgcaagaatctcattgcaacgtcgaatgtagcaccaccccaacattctaaagcgaaagcacctgcaagggcatgtgcggttgttggagcgattgtagccaaatcgtgggttctgactcttgttgcaagtagagattgatgagcgtctctccaggtggtgtccatcagtagagtaccattgaactgtctgacttgcttggcaaattcagatggtcccttttccagtagcacttgtctccatccggatggtggtgcagactttgtaacgttgatgacattgccctgagcatcgtgcaaatgggggacacttggatttgattttagttttggcaagccaatttgacccttaatagaagaaccgttaactgccaagtctgccaaatagtgtaacagtttttgcgctctgttttgtgacgataccatttggaacagttgtggggtgtcgtcaataaaagtcgtccagtatgtaccctcaataaaaactggattggtcaaaagagtcaataggaagggaatgttggtcttaacacctctgattctgaattcgatcagggcacgaatcatcttcctacggacgatttcataagtagaaccagagcatgaacatttgaccagcattgagtcgtagtgaggcgagatagtagcacctgcataagcgttaccaccgtccaatctcacaccattaccaccggcagaacgatagacctccaggcgaccggtatccggttggaaattcttagagggatcttcagtggtaatacgacattggatggaaaacccacgggtggtgattttatcctgtaatagacctagttgagtcaaagtggcacctgcggcaatctggatttgggcagaaacaatgtcaataccggtgatttcttcagtgatggtatgctccacttgaattcttggattaatttcaatgaaatagtgtctgttttggttgtcaaccaagaattcggcggtacctgcgtttctgtaaccacataccttagctaatttaacagcatctgtcaaaatagcgtcacgaacttcacggggcaaagtctttgctggagcgacttcgacaactttttggtgtcttctttgcacagaacagtctctttcgaaaagatgaaccacgtttccgtggttatcagccaacaattgaacttcaatatgctttggcttgtccaagaatctttccacaaagcaggtaccattaccgaaggcagtacgggcttcggaggtagcacgttgaaaggcatctgccacgtcgtcaccttctctaacgactctcatacctctaccaccaccaccaaaggcggccttaatgatcaccgggtagccgtattcattaacgaagtcaagtgcctcttgcacagtttcgataggtcctggagtaccgggaacggtaggaacgttagctcttgctgccaagtgtctggcagagactttgtcacccacagagtcaataacttcagctggagggccgatccaagtgataccggccttcactactttgtcggcaaattccgaattttcagacaagaacccataacctggatggatgaaatccaccttatgcttctttgcaatttcgatgatctcgtccattgccaagtaagcacccacaggtgtatactggccctcctccccgataacatacgcttcgtccgccttcaacctgtgcattgaaagacggtcctcatgggagtatatggcgatggttctcatagacagctcatgagcagatctaaaaattctaatcggaatttcacctctattggcgaccaagatcttattcttttcgccgagcaaactgaaattgtccctaagaccggccaatttcttgctactgctcatattttattttgttctctatgtcccttattttctctcctagtaactgtcctttattttgcaatatagtaattggcaaaaaaatcaaactcaaatgacgggccacagatagtaagctacaagagtttggaagaaaagaggggcttgtttatgtatgtaatcaagtaaggataccgaaagtaagagaaaagaaaaaaggactaaaaatcacagaaacacaataggaaatatccgatggggagtacttcttacttaacactccctgcgccaattctgactcttataataaatagctcgagacgtaactgccaaaattgtaaaaaaaaaatgaaaaactattagaaaattaattgcgaaaaaaaaaaggttagtcatatgtgcctttgcggcgtcttccgcaggaaggacccctctctgccaatcacagaagagctggctgtgcctgtgcggtacgctatcagcagctgcgtcgggtaagggacacgtcgttagtgacaatcgtggttagttttcgtacagaaagatgaccttaattgataattaaagtatagaaatgtcgtatagtatatttttcccttgcatggaaaaaactgggataatgtgatgattctcattaacagatttacactggtattgatactcattttgtttctgcttcctgtagtacataaaaagatcttgtaaatattacgatactcgttaaaattttcttgaacgtaatgtcgtacaattcttgtttgaggggtcgttacgtacatctccaggaactgattggcagactttgtaaatggaggattttccttttcaaatatccaaaatataggaaaagtccgactacaatacatatgagattggtgatgtaatagccgtcacgcaggatggtcacggtgccattcaaaagctcggtgcacgcttgcatgctgccgccgtgagttacgtatactttatttgtgccaggaatagtgcactgatacacggtgaagtagttgatcatggacataatgattaaccgcggccatgtcccaccgaagttgctgagggtatttaacaatgtcatatatgtgccacccagcacggggtctgcaactcttgtatggaaggccgatattccaatgaactggacagtattcatgaaggaacctaagaggtgctggaatatcacgagacaaaaataacccgtggatatttcaccatccttggggaattgcttcaccacgtaacttcccaagaccgcggctgccagacggcccaaaaagccccacaaccatggtgttaaaacgccggcatccccaactaagaacttgatgaccttgttggtgcccgtgctgtttcttaatcttctattgtcacgaatcatggggtccttgtcggagctccatttaacaacatagtacccaaatatgatttcgaacggcaggtctatgagtactgtcacagccaagtcttctcttttgaagccttgctctagtagtttcaggtttgtggcggcttcgttgcattgaaaggcaaatttcgaaatcatgtgaatgaaggctaggcttcttacggacttcaatttcaacacttttataaagcagcggtaaatgtactttatactgcttgtattctgagttgacaccacatcaccgtcgtcatactcaatacttatcggctttgaccctccgtcacttgtatttatgggctccactttgggcaaatactctacgtagggtttttccttggtgcaaaagatgatatatatggttattacaatgtaaagcatgcccgagaatttcatgtacccaccaagactaatgaacccgtgatccagtgggatgtttctgaaatacttattggcgaaatcagaggaattcaacgacaggaaaatggtaaatgacataaaataaccaatattcaaacctattgtttgcgcggtagatgcatatgatagggattctttggacaaaatcgtcaacgcccaaccatcaactgcgatgtcttgagtggcacacagaaaaactaacaggccaaaccaccacgtcaaattttttatactgacactgtgtaaagtgccattaccgcgattatggaacgcatcgtcgacaccatcgaagattatgccttgtgatatgcaccaccctaatgcccatagcacaaatccactaacaaattgtactggaatgatccatgatcttcttctaccgatgcgcttgttgtacagtgagtctactattggtgaccatatgatctttaaagaatatggatatgtagccatagagaaaattcccagtgatgtaaacgaggtctcctttgctaaagatttcagtagaaacggtacggtaccgaaggccaatcctacaggtatgccttgagccaaatataacataattaaaagataaaattgcggcaaatcatgcttggctagtgacccgctctttcgcttaggttccatgcctacttttgttttatccccctataactatggtatattatactgcctcaccaaacgtttaggtcttgcttctgcttcccacagtagcttacgcattatagccgatttatttttcacttattttcgcatgccagagtatctttattttctttctttcattcagcctgtcgtcgaaaagaaaaaaaagaaaataaatatgtgcgtattctaaccatgaaacaggaactcattcaatgtgcacagtacttatctcattcaattttgtaaaaacaaaatatatacattgtatgtatgtgtgtatttgcagttatatatctactaataaccagtacgccatacatgtcttgattagcaaaatattatttatgtttttctcattagtactatttccgcgaagagggtagaaagtgtagggtacagggaaaaaagttccctatctccttctttctctccttcctattggattgaagtttatttattcaattgacaagacttctttgacagctttaacgatggttggagtatcagggaaagcgaaatcttctaattctttagcgtaaggtgttggaacatcggcaccagtaactctttggattggagcatccaagtaatcaaaggcttcagactccataacttgggcgacaatttcagcaccaacaccaaatgatgggaaagtggattcaacagtaatcaagtggtttgtcttcttgacagttttgatgatagcttcagtatctaaaggtctaatagaacgcaagttgataacttctgcagagacaccatatttcttttgtagaatttcagcggcttccaaagaaaactgaacgtttcttgtgtacgtaacaatggaaatatcggtaccttctctttcgatcttagccttgtatggcaaggtgaactcaggggataaagcttcttctgagatttcaaaagattcaccgtacaacaattcgttctctaaaaatacaacagggtttggatctctgatggcggcctttaacaaacccctagcatcttcagcagaataagggacaaggacctttaaccctggaatggaaccgtaccaaggagaaaagtcctgtgaatgttgagcaccaacacccactgcagcaccattaggacctctgaagaccatttgacatttttgagtaccaccagacatgtagtgagtctttgcagcggaattgacaacatgatcgatagcttgcatagagaaattgaacgacataaactctacaattggcttcaaacccttcaaagcggcaccaacggccaaacctgtgaacccgtattcggtaataggtgtgtcaaccacacgacgttcaccgaacctgtccaataaaccctttgacaccttataagccccgttatattgtgcaacttcttcaccaataaggaagacatcatcatcacggtccaattcttccgccatggcactattcaaggcctctctgacggtcatcgtctttgttgatgagaatctcaatgctgctgctgctgcagagggtcttacaaaagaagttggggcacgacgtgcaacatttctggccaatgatgttggcagtctggaaaacatgttgaacaaaattattgcaaaagtaaaagaacttactaaactgcgatcgattatcaatgaacaaacacaggaactgttatgagggaggcggaatttaacgtccgagtgtgtaaatgatactaaattagtctaacaaaaggaagaaacttgacagagataatatcaagagtcgctgttgcaatcgttaacctgtatatgtagatacacctctttttattgcaaacgtgcaaacgcatgacttttaatgacggagaacttcttagttgaagactcgtctcttttgcatgttctcccacttcgaagtctcggaaaacagaccccggaaacagccgcgacgaaaaagaatcagcttaggcatgataaatactgtggtttcattagatagataaaatacataagtattggcgtatataaacgggtgccagatagaagctttcagagagcataaaattgtacaggatactgcctacaacttactcttatttctgctgctcttagcaaaagtttctgcgataactcttctctggattttacctgtagcggtttttggtagcttatcaacaaagtacaccttggttggaattttgaaagaggctaggtgcttctttaagaagttcaccagttcttcgtaggtcattttttctcccttcttcaaaacaatggcggcttgaactacttggccgtacatatcgtcgggaacaccaaatgcaacggcttcatcgatctttggatgcgatagcataatgccgtcgagctcaatgggtgaaatcttttcaccacccctgttgataagctctttgattctgcctgtaaggaccaaaaacccctcagggtcgaaataaccttggtcaccggttctgaaatagttctctctcttggtgaagttctccttgttagcttttggattattagcataccccaaagtgacgttttcgcctctgatggaaacttcgccgactttgcccgggggcaagacattgtcattgtcatctagaatgacgacggtgactccttgtggctggcccacagtaccaggctttctctttcctggaggcagattgtttgaggtcatttgatgtgatgcttcggtcatcgcataggcctccaagacaggtgcattgaattccttctccagcttatggaacgttgctggagccaaagcagaagaacacgatctgatgaatctaatgtgtgggaaagggtttggtttgggcatgttcagcataatcatgcttattgtgggaacgcaactgaaccaattacagttgtacttaacaaattggtcccagaataactttggatggaatccatcgggaaccacaacagaaccctgagttctaaaagtggaaagtaaaacaccaattaacccatggacgtggaaaagaggcatcacgacataagatctgtccaagggcgttagcttgtaagtgttagcaatgttcaacgtgcttctcacaatgttcaaatgtaacaaaggcaccgtttttggagtggaggtggtaccactggtatgcaaaatcagggcaacgtcactggaacgggcaaacccagggaatttaacgggatttgtgttgacaaatttggcgttgttcaaagaccggtaaataacccttttgtagttgtcctctggagagtatatatcatactctaccctaaacctggtcgcatcgaaggccagctctacgataaaacatccaaacgtggaggcagattttagaatttcagaactctgtaactttgtggtaccctttgggacgcaaatcgccttagatttcaggtcattcaaataaaaattgaactccttttccttataattgggattcaagggcgcgccaattttagcgtccatagtagcaccgaggaaagcgacgataaattccagcccattacgcatggatatcgccactgtatcttgtctgaaaacagctccgtacaatggagaattaggatttgtgaacatggtctggaagtgacccaccatgtgggatagatccctgtaggtcacctgagtgtccgtttcaggaacaataacggcgacattatcggatacgctaaaagtatcgttgaacgaagcagtaacagtagcggcacttgtcattgtagcaaaaatgtgcgtgaagcgtctaacctcttgcagcacagtgggagtaaatttcaagaaggagcatctattaaaaagagcttttaatcataccatctctatttatatacagttaatcttgaaaaataaaaaaagaccgaataaaggactcggaagctttagctcggaatagttaaagacgctttcggcccgagaaaaaaatattctgagcaccaaaatccaatcgcctgaagtttatcaagtaaatttgccattcctggccccatatagtgatgcctaagtggacagcaacatcgcgctcttacttgttagtcgttctcatgacgagcaaggcaaaagcactcgtcctcagctaagtcgtatggtatgactggcagcgtgaatggcacggccacatgggtgggattacccgcgcagcctctacggtcacgtgtaaaagtacggcacgtgaccttcctggtatttgctaacctgcgactatggtaaagcactcctgcttcataattgcgtggttttcttgaaacggtgccccatgctgtttggctgaggtttgccgaagtataaaggcaccattctagttctttaaatacctgcgatgcatcacagggccctgcggagtttgttgcacaatgcatgtaaaacttagagtgcgcgggcgtcgtccctcgtcttctagtaaccatagcagggtcttgcttgtaaaatactttgaacttgtttcgcagcatttcgtagtagctctttttctgaagatattgaaaatgaaaccacccggaactggaccactttaagggactggtgacaaactcttgttcggtggggaaaataatgtacggcttgatttttctctgcgaatattcattaatcaatgaattcgttggcagtatttctgctttcttcctcccagcggtgtcctttgctggaggggacatgattccggtaaacagaggaatcattagatgtgtccataagttttcgtctcgcgctcttgatagagatgtccctatggatgaagtttgacatagataatgttttgcagtatcactagcacttgtgccagcagaaagtttttctagtttattgtaaaacgacagtaaacccgacgactgaaatttggagggcgtagaatatacaaattctaattcgctcaaaggagcaaagttaacttcctctacgctttttgtaatcaattcgtcaatgtctttcaggtggtacgaattgaggtattctatcaagcttctcttaaacggtactggtagcccttctttacctattttcaaaaggggactgcaccaacacacctgttgaggcaggttagtctccattgacgtaaaattgttagatggcaagaatattttgcattcgccattatcgtaaaagtttatgatcagcttcgtatggtgggaagcgaatgggggcatcgttatttcaataagtttgaccttttttaatattactgccagtgtcgcgtccatagcacgggcttcgataggcataatagtacccttttggccgacgatggttatgttctctacgttctggtggaattgtctcaacaagaaatcaagttcgtattggaaactgaagagtatgcttctttttagtgtctcagtgccaaagatatctttcaatgtaatcatatcctctacttctcccataaaatcctctctttcatagaagtccgatttcattagtttaaaaacggcaccttttgccgtatcgtttgtttctattctctcactcaaatcttgttcctgattagtcaaatcaatgattttcgattcactgactatgacgcagtcgtcgctatcattgttactgttgaccggagccatattctccatttcagcactatacctgacgctcttccaccgttgtgctactttctcggcaacatccgacctcttcctcttagttccattgaaatttgtttctcgtgacattaatgatcggttgaaaacacattatcatcattcttgtctgggctcaccgtttctctgcattattttcctctttataagccctttattaaattaccattttcgcagtttagtgcggccgccgaaaatacatcagaagggatccataccaacacttaccaagaacgctgaaacacgttgttcacatcacctgaaacaagcagcagctactggagaagtgtgtaaagtagtagtaattattaaaggacacatattgaaggattgttcaattttcttttttattatttttcccctcatttatccactttttataaactgctcaagtaaatacaatgggctccaataaggaagcaaaaaacattgatagtaagaatgatagggggttaaccagtataaccagtaacaaaatttccaacttaaaagcacatgataaccatacaagttcaatgattactgaacataaaaatgctgacaaagaaaaggggaaacaagaaaaagagagtagaaatggaaccacgcaatcaagtagttcagtagaatcacactcaccacaagtaagccatcattcagataagctctcgtcctttgattcgcccttacatttgccaaactttagactggcggatgacttgttctcaaactcgtcaagacgatcatctgactccgctgcctcatcctcagtatccaaactgaagtccgctcagctttccaaaataggtctacatcatcatcatacaagtaataataaacatagtcatagaagcggaactccgacttccgaagtgaaagctaattactcaccagacccttctgcaccgcgattcattgtatccaatatggtcggcaatggccggggaggtggtggtctacacggtgcaacttcgaacgttgtcaagaaactccattctagaaaaaaatgggactggaacactttaccggcatcagattcttctcttctaatcaaaaccgtttcaggaaatcataatttaatcaacatttgcatagacggtgaattcaaacaaataatgtacgacccgaatcataatgagctctttaatagaatggacttgtttctatcttttaacatggactcctcgccagaagactctttaatatttgccaagaaaagattacggtcgtacattgatttcctaacaaaatatttggaatctaggaaatatgcatttgaatgttatccatttaacattgaaaacatcataaatatagagactgaggttaaatgctttccatcgtttgacccgttaaaagattattctgaaattgaatccttgattcaattatggttggctcaatctcaaaaatttttactgcaatcaaattcattcttcttttcatctgaagtagtggaggaactaataaaaagaaaaccaaccacaagacaacattctaatccaacaatcagcaccaccagcaacaagatcagtgaccctacattatatattcagcagttagatatagaagcaaactctccaaggccagtaatatcggatccattagacgaaattgacatcttattaataagaccgctgcataaaaccctgggcggttggcagctggcgtatgatgaaccaagcttgaacatcgcagatttcgcattagatttatctccctggatgattgacagcagtgacaatgacgctcagaataagaatgctagtgaaattgctcctgagtatttaacaaacttacaaaattatttgccacgaaagggttcaagagcgaaaatagtttctgacgaacaagaagttatcgaattgaattcttccaatgcttcagagtatatgtatgattgcatgaatagaaagttctttacagatgatgcaaaagaacgtatttctagaaacaacttcaatcagggagttgaggaagaccctctaaacgaccaattcgcttcaagtagatctttatcattgccgtcctcgggagcagatgctgtcaaaaggaagaagagccctaccaaggctactaaaaaatctggtttcgtcaactttttcaagagaaagcattctcaacttgcatcaacttcacatactacaagcccttcagtttcacctagcatatcttcttcttcttctccaaaaattcaaccacagtcacatatctctagtccccctcggacagagaaagctccccatgtcaaatcagccaaccaagcacatcaaaatgaatggttggagaattttttttgccggactttgaacaactacaaagaaatcgatttaccgacccaatttattttgccaaaggaagtgaagaggtcctctaatgcacaacttcagcctgaagatgaaccacctttgtcatcaccaatatcctctaattcggataactcctttccaaatgaaggacttgacagggcaaaaagcgcagctatttatggtaaagaatatttaaaattaagactgccgtttgcatcagacactatacctgctgtaatatgcccgtgggtctggacaagtttaagttattataaatggaaagctctacttagggaaatatacagatcaataattcctggcgggtacgcgctggcaattgttccagatttaaggatttcaaacacatactatactggaattcttggcaacgccgatgccgaaaaagcaaataattcatcagaagagtttttgactacaaaagaacgggacaagacatttgatgctatggctattgatgcgataaataaaggcttacatatccatcctacaaaacacttaacgaggacattcaaggatgtagggtttacaggcatcaagtcctcggtcctaagtttgaaaactggtgacttcaaaacagatatgggctttttgaatgaatttaattctttagatatgtgggactacatgttaaggaggcaactaccagatagtagttgtcctccaaaggataccgaccccaccactcttttcaaaagatatgtggaagaacacataggaaaaatcgatgacaacgctggctgctttagaactttgtatgtggtggcgcaaaagccaaagctgccatataccaaataattgtgccgccgttccaatttttttttaaattgttcaagaattacttcaatttttactactggacaaaaagcattatgataaggagtagtctcccagtatcgtagaaccaatttgaaacactttagccaatatttattaattttttttacttcccatggcatagtactttgtaggaagattatttgttcatttactacatttattacatctatatttatatattctataccattcatttttttttatgttaagcttctcttgggaattgttggggtatgaatgttagcagaatgacccaactctttttctagcataactcctaattttttatcttcttcagaaacgtcacgaattaaactgtccttttcatcaccagaatagtattttacgtccacttgggaagccaaagagtgctctgtttcctgtaacgagtcgacagtagcttcgtcgattaaaacgtatgctatgttagaacccgggcaatcataattaacgtttagcagaagtctttccattatccctctcaaccctctggcgccagttccttccttgagagcaaattgagcaactttctttagcgccttttgtgtaacacacaatcttaccccaaattgcttaaaaatatattcatattgatccaataaggcatttttaggttcttttaatatatgaaataaatcgtctctttgtagaggctgcagagcagttataattgggactctgccaattaattcaggaattagaccaaagctaactaaatctgtgggggtggtcaagtctaaagcacacactttttttccgttatctaattcaacctgctcaagcgtattgctaaatctgaacttcttcgctctttctttttcaacttctttactattcgatgattcaacagactctcctgccttctgtattttcttcatatcttctatccttttaacaatatgcttatctaaaccaacaaaagctcccataatcatgaaaagaatatttgaagtgtctacaacaaatacttcgtccttctttgttgtagtttgatttttttgtccgtcaatatcatgcttaacaggccttttaacggtaatttccactttatggccctcaatgattttcaataatgactgttgaaccccttctccggacacgtctttagtgccaatgcttgcggcaggcttggctagtttatcaatctcatcaagaacaataatacctttttctgctctcgcaacatcaaattcagcatttacgagcaatctttcaatgcatacttcaacatcttcacctatgtaacctgcttgagtcaattgtgtacaatctgtaattgcaattggaacgtttaatattttcgccaatgttgttgccaacaaagtcttaccagaacctgagggaccaacgacaaggacattacttttgcttaactctaaatcttcgtcaacctctctacctgctaaattaaactgtctttgaagattcctccaaccagcctttgattcgctgtttccactgaaaattggttcatccctatcatccgcgattttctctcgttccatcaattctctctgcctttgtaattcccctttcttttgcttgtcattgattcttaaatagtgattataaactgccacgcttaaaaccttcttaccaatctcttgaccaacaatgtactcatcgaggaatttcttcaatgcttttggagtgggtatattcgataaacgagactgtgccagtttccctgatgctgtagcagcatatcgaccaattctactagaataagctctaaaaaagttttggcttgcagatttcaacatgagtgtgaaatgtaattagagtgccttgtcttctatggttttgtttgatgagccgtttgcttttctttttaattttaatatataccactgatgacttattcccttctatcatcgaaaaaatattgtcaaattaatgttctcttttttcaaaaaatattaaaaagataagaaaggtaccatgtcgcagaaaatacagcagcatcagtttcctgatttttattgttgttatctactacaatcgattaacaagaggcaatcattttacgttggatcaactcctaacccagtacgacgtttgaggcagcataatgggaaattggctgttggaggggcatatcgaaccaaacgtgacggttcaaggccctgggaaatgataatgattgtgcggggcttcccaagtaagatagcagctttacagtttgaacatgcatggcaacatgggtaccaaacgcattatattgccgaaaaagatcgtgttgtaaagcataaagcaggtggaagaactttacatcacaaagttgcattaatgaagttacttttaaagcatgaattttttcaaaggatgaacttgatagtcgaggtttttaatataaaggcttgggaggtttggaaacaggacaaattttttattgaaagagacagatttccgattaatatacaaataaatgaaaatgcgcttgaagaaccaaaggagaaaactgtggatgttctcatggatcatagtgatgagaatttaaaagtggtggaagctgtatacactaaagtcattgaaaatgaaagaaacatattcgaaactttcgaaaagaaactaactacaggggtagtgcgatgtgaaatttgtgagaaagaaattgactacacgtctgaagagcaaaatctgaagccgtttgtagcgctttgcaataataaagactgtgggtgtgttaaccacttgaaatgtcttcacaggtactttctagatgatgaacagttgatggtagggagaagaaatttgatacctcgaggtgggaaatgtccgaaatgtgatatgttttgcgactggacgaccctagtcaagttttcgacaagaatgaagttagctcacgggaagtagggcctgacacaattttcggttcttttttttctatagataatggttatatgttatatttacggatatttttacgtttactttgtaagaaagagctaaaaagatgtaaagatatcacttcgtttttttccctcaaaaaataacttcccaatcttcagttatgtcaagcgataggttaagaatggtgatcttattatcattctcatatgacgatctagtcggcaatgaactttcttcgccattttttttgactttaatactgtctttcaacgttatgttgtgttgtaaattattctttgcgataatgattttttcaatattggtattcctcaaagtattgtggtgaatgcctgtcaaattctcgggaatatgacttcgaacattttttaaggtattgttttcgaaaatgaactgagtttctacgtactcacctctttggtagccaaaagtttctccatcatcaacataaagatctccaacggctcgtccctcggtatcaggggctataactattacatatggatcgtttttcattaacattgaagatcttctatacttatctttcatagtgataatgtgaccgccttcaataaataatggaattttatccaatggtgcagaaatattcttttctatcaaatcagtaccattgtttataaaagagtgtaaagatgcgaattcatagaatataccgggtgggaaaaccatttccgtttctgattgaccaggctccgtgacaggtttgactaatagacctgaattactccagtaaaattggttatcgatatgatacaattcagcaaattcagggtgttcaataaacattggattcattatcggaaatccagtgacacttgatttatgaaacatggtgtataaggtaggtagcaggaaatatctcaattggataatatcacgtactatcgacttcaaaggttcattgaataagtatggttctcttctcttggtgtctatatgggcgtgtgctctaaaaaatgggtaccataagcccgcttggtaccaacgtgcaatcaattcaggtgtaggatcctcagcaaagccagctatgtcggctcctataaatggcataccagcaatgttgtttgacagaaccataggaatggaaatctttaagtaatcccaattggccacattgtcaccagtccatgtggcagcagtacgttgagagccggcaaaaaaagcccttgttagaaggaaaggacgcttatcggatggtgaataaatcgattttattgcgtcgtaagtagcttcatgcactgatagaccatatatgttatggacggatctttcctcaatgtaattgtcgtgaatcaaatcttttggagctgtggtctctgggccatcgaaaatcgaaggctcgttcatatcattccaaatgaataaattagttaaatcagccggcagatccataaaccgttcgaaaaaggacttccaaatcttttggccatatttgcttatggtatcaatccatatagaattacctggccagcaatgacctacatagtcatttccattgtgatccttgactgctacattttcattaattaccctgtcactgatttcataatctttctttaaatgaggatcgattagtacgacaagatttctacccaacttttttaatttggataacagcctttttggattgggaaaggagtgctgcttccaagtaaaatattttttgtcgttcgtatactccaagtccaaccaaataaaatcgtaaggaatcatatgagcatccatctgagagtccactgtgagaacgtccatctcatcattataattccatctacattgatggtaccctatagaggaaatgggcggtaaaaagggtctaccagtcaaatcggtaaatttgtcaatgatagttggaatatctggccccagggacatgactacatctatgacaccattttcggagatccaatgagtcatcgttttatttttactggtgtcatactttatgtctacccaagtgtcagctgcattgacccaaaagatagatgtggacgaagatgaaaacatgaatgggatcgaaccgtacattggttggctggtaccgatgttgtactcaaagacatcaacgttgaaaagcctgtagggttcctttccacctgaagtgtccatcagccttagcgacgtcgcatgttccggtataccgtagacattagtagaacccatgaaagagaaatctagcgcaaccgattcaggccccaaaggcatagagtcatgctttgaatacaagaaattgtccttaaacatgttgaaagttgtttcttctggcagcacgtgtgcgaagttttcctgcttagttctatgatgttcaatgttcaggaaattttgctcgtttacaataagtttcagcgcattttgccagtaaactttcaattgaaaaggttcagcaaagatttctacggatacatcaccgtttcgaagatgaaatgtgtctgcagtggagtttgaaagtgacaaaaatgaagatattttcgaccagaatgagttcacagtttgtttttgcttaaggaagtggaattgtggaatactggtcctgttcgcctcctcttgaaatttcttgtcgaatgcgtacttccaggtctcattgaaccgttgtgaagagatcaacaaaccgctgctgttggttggcattctctctttctcatttatagtgaaccttactgagtgatcctgtaaaaaagagagagagaatgggaactgaacggctatatcatcgccctccaatcttggtatagttttaattatggtagcatgaagcacattctctaaaggatcgtgtgcaatagactcggcgtccactttgtaatagcagtgatgagatttggcaatattttctgcataaaccctgtttctatggcaaaacccagattgcgcacacttctttaatagatagtcggtaaacgcatgcgaaaaagcggtaaagaagaccaattggcatacgagccatttcaaaaggaccatgttgcatacggttgattcgagaccgctattttaagatacgcagagcaatcaaataactccaagcaacatgttcattgagttatagctctcaagtgccgtagtgagaaaatgtcgtggtccgggtaaaacaaattaagggtacttgaaatgaaaaaagaatgatagtagacagaaaagctattatattatagaaacttatcacttgaccgatgaagaggaaagcacgtttccttacaaataaatcagcagtaatagttataaaaatatatgtatataaagtgtgtgagtgtgtgagtgtgtgaaaggatgttattaaatagtatgttattatttcttgtcgtatctggagtagtatttctttgaaattataccgtccagcgtcaaaagacccagagcgccggcggttgttgctaagactgtagagttaggtttccccttcaagaatctggcgttgtggttcgcatacccgttacataaataacataccactgaagaatgcagcaacaagttgaccaagacaacgggattctgaagttctaaaaagcatactttggcaaagtcttgcgtcttactgacaaaagcttggaggtagccgcaagcgactgctgatgcactatttaaccgtgccttcagatattcgatagcgcattccttcttattgttgtggtggtgaccgtcttcagagtcagaatttgggctagcgttactgtcgtgtttagcactggggaaaagaaagatggtcatagatgatatacgttagtcaaaagagaaccgggagaaaagattaggcgatacgtttcagatattagtgtacatacgttgcagacatattatgagatgctggaggtagatgttatgtttctaattgttggaatagggttacgtcggcggtttcggttgaagtgggcacattgatcgacactttatatacgcagggacgattaacgggagaggaggtagcggcggcgtcattggccgctggcccggggtagtagggcagggaaaggggacggtgaaaaaataaaacgtaagtgggacagcagagatttgaggagttgaggcaagaacagaggagagaacgagaaagcggataagcaacaaaggaaaaggaaacaagtaaaaaaaaaaaaagagactagcatgagaaacgaattataccagttatggtgtgtggcgagtgcagcaagaggggtagccaagagctcattcgtaagggccaattcggccatgtgtgagtacgtgcgcacgtccaacgtcttgagtcgctggactcgggacaggcaatgggaagcagctaaggccctatcacaacgggtcaagaaagagtatgccgccaattagtgcacacacatacatatattttatatacttacatatttggttgcgtggtatatagaatctctcctttcgcttcatgaatgaactcattcatgcgaagtcaaaggaaaaaaaaaataaaaaaataaaagagcgaacgggaagacgagagaaacatcaagcgaccaaagtaaaagtcaagaacgactccacaagtgcgagggtcgcgacgtctctaactttaaaaacaggcgtcaaccatcaagtccgtttcttgatgccgccggcattcttcaaatccctccaaaaaaaacgcctctatgacataggcggttaataaaactggccttgaaacaacagatgcagtcatggctcttctcttttcccagcaaacgccttccattgcctcctttttttctcttccagaactctctcagcagtattctcacaaacacatctcctcccctttagcaaacctccatttatatcctgcgagaagagctccttctcctcaatgagaaaataagcacaaaataaactgggaaaaaaaatatagtaaaagacgccagcacgttaacaatggaacactcttattgtagaccaaccccaccctacaccccctcaaaccgaggacacttcaaaaggaaaatcaacaactttggccgatacttgggggataagcaagcttatcctattacatcaaaaaaagaatcgtaagacacctttccttgcaaaccaaaaatcataacaaagtcgaaaaacttcctcttgcagcgccaccagaaaaagaagacgagcgaagaaatcaacaataagagcgccccatccgcactagcaccccataccataaatattatctcccaacctactatagcaccatttcttcccatcgataaagaaaaaccaaatcccgcgttggacataaacggctcggaaagacagggaagagtatgaagcaaaaagccaaactaagggagaaacagaaagctaaaaaaaagaaaatagaaaacaaccagaagaaaacaaaaacaataaccttgagcaaccgtcgtctcaaaaaccaatttcgaaaaaccatcataaaaacgccttatgaagaaaccatgagcgaagaaaaatagcagcaaaaagtagtgagacctgacattagcggaaaacaacttgcttaaaaagtctcttcccgtccattttattattttgggtgccaaaaaatgtgtattgtaacaaattaaaaggtaatgagcctcattgaggtcatttcagttgttacactgaaaagaacagatactacacttgatctaagccaaaaggcaaagagattcgtggggatttaaaaaaaaaacaagtagaaacaaaatgaataaatctgataacaagtaaagtactcatcgatgaaaaaatgaatgtagagccctttttatatgttttcaccgagtggcccatcggaaacggcaaaaaaaaaaaaagaaagaaaaaagaaaagaaacatagagcgttgctaggttttttttgccacccacacccatacaccccattactttgtctgcagcatcgttatacacgtagtgaaagtgtgcaggcctcggcggttaaaaaaatttgagcagaaaagcatgttatttaatacatgtaatatttgtctatgaagcttcgctatcctgctgcaactgctgagcaagttgttgccggcgcaattctttgtatctctcgtcctctgcagacccgacccgctgcagaaattcttgccgggccaagaacccatccttgttgtgcagcaccaattcgtcgttaagtccagcacggtctacataactagcccagtccagctgagatttttctaatgtcgttagcttgggtcgtagcccgccagaaatgatctgctccaacaatggaggccttttcagtggccgtcgcaagtgttgccggctttcattggacttggtcctaactgctttttccagttgaacaggagcagcaggcgcctgctgcttaaatttcaaactgtttagatattcttgaccctccgcactgctgcgtgaaacccattttttctcatggacagtttcaccagcaaacttgtagtttctttcgatgaggattttgtcctcctgttgcgcggccgttgtcgacctagcctccttggaaccgtcgagaacagagccgactttccctgaactgctcaaaagacggttcttactagcttcctgtagctcctcccagatgctgtttacttttgcagggatcgattcaacagttaacgattcatacttatgtgttttcgcatattcttcctcagcttgccgagctcttctagtcttgatcagtccgccgctctcgctctctatacgcgaatagtccactttatttctacccttatctctgttcacaccgtcatcatagtcgtcaccgccatcgctggcatcactatcgtcgctaccaccacctaatttatctttttcaggctggaagtcctcgtcctcctcttctatgtagccgtcctcgtcctcgtcctccttttcgtttggtataatctttgtctctacttctggcatttataggctagtgggttttctttcttgaaacaatattattccagtttacgccttttcgtcttttttcttacttgtcgattaatcctattcatcatctttaaacttcgctctttaattcacttttttttgtctttccccgatatggtacttacacgaaatatcatgatacaaaagaaaacacgtacatactcgtcaaacgataaatacgcacctagtcgttagccgcataagtaacctttttcatattcaaacttatccatagccacatccactctaacaattttaatcgtccagcgcggcattaaataatctttctgtaatactctttagctcaattatgtccacagagactacaaaaccatcaatcactactacaccaactactgtactcgtttctcccaacacgctcaaaaggaaaaagggtgaagacaccagcgaggaacaactggaagcagaaatcaaacgcgtggccctgaaggatgcagacagccactctgacaacgaccacgattcccccgacaatgttccctctgatgtacatttacgaatgctgtgcttagtcaaacacgcttcactgatagtaggacacaagggcgccactatatctagaataaaatccgaaacctctgctagaataaacatatcaaataatatcagaggtgttcctgaaagaattgtttacgtgaggggtacttgcgatgatgtagccaaggcatacggcatgatagtaagagcgctgcttgaagaacatggtaacgaagataacggggaagacattgagatttctatcaacctattgatccctcatcatcttatgggatgtataattggcaaacgtgggtctcggttaagagaaattgaggatttgagtgcagcaaaattattcgcgtccccgaatcaattgctgctttctaacgatagaattttaaccattaacggggttccggatgctatccatattgctactttctacattagtcaaacattgctaaactttcagatggaatctccgcagaaaaatgtgaaaaggtccatatactatcagccaactcagtttaactcagtattaatagaccatagccaaccgaacaccattttccatcaaagaaaccaccaatatcatccaagcgataaactactttcatacaaacccaacaaaaatttaccaatatcatctactttgttgagtatggccacaccgcagtatactactgctagcgttgcaaacgcaacggcctttcaaccgaacttcgttatccctaatgtgacagtcttagacggccctgttatcagtccggcacccggcaaccatttattaatgaactttgtacaacaagagatattcatagatgagaaatttgtcggaaatgtcattggcaaagatggcaagcacataaattcggtcaaggaatccacaggttgttcaattattatacaagatcctgtagaaggctcttcggagagaagacttaccataagaggtacgttcatggcgtcccaagctgctattatgttgattagcaataaaattgaaattgatagatcaaatgctgaacgtaaaagaaggtcgcccctctaaatatactgctagtcaataaaaacacatagaaaataaaaatacagaaactacaaaaggcaaaaaaaataaaagaaaaggtaataaattgaatgaatgtagatatataaatatcaatagaaatacgtacgcggaattatttctctttgtaacaaattgatcaaaagctttgtattttttttttttttagctcggctgcgcgctattacagtaattacatgtaaataaactattccaaagaatacaaaagaagagcttacagtagccagtcaaagtcgctgtgaaacatacacggcgttgtagtcacagtatggaacacaatctttcacctttacagcaagaagtattggacaaatacaaacagctttctttagatctaaaagctctggatgaaactataaaagaactaaactattcgcaacacaggcaacagcattcacagcaagaaactgtatcgccagatgagatactacaggagatgagggacatagaggtcaaaattggtttagttgggacactgctaaaaggtagcgtgtactcgcttatcttgcaaagaaagcaagaacaggagtctttgggtagcaattctaaataatggtttggtgcaagaaattgattctgatgctttattttttacggtacactacattgtgctgtgagttgtaataatatagtctgtatatgccaagtgaagaaaaaaacaatacaaactcaaggtgtattatgaggtagggaatacacataacaatatatatatatacgtatgtatatttaaattgtataaatgacgatcttaccgtctaacccacaggaagagacttgtgtgatttggccgttggattccgcaaaaggtcttaattccacaatggcgttttcatgtgcactttcttggacatctgtgctaactttacctttcaagtctaattctttaaactttctcaatgcggaaataccgaaagttgaactttcatcattattaccactcagctcgtctgtattaccagatgcagttaaggcagaagacttgttattgtctgatttgtctagattcttcgcaaatttccagccttcagaggcttcgctgaacaataccggatgacaagagtatcctccacaaacaatctcgtggtcgtttatccatactaaggacctgtaaggtaaaccttccggagcattgacagattgcactggagattggtaatcgacaacattcaaagtaccatcatgcgctacataagcaattctttccatctgacttctccattccacatcatggatataagaaccctgataccactccctgattaaacaaccaaaagggaatttctggccccagggtgatccggcgacggattccttggaatccaaacccttgataaacccgctgaacacacgcataaacccatcagtaccaccagcagctaataggactccatttgcatgccaagacaggcaattgatggtagatttgatgggtttcttgatgtgcttggatacccaccaattattctcgtgttcgtaataacaaacagcgatgattctagcactggacccaacagcaaacttataaccatttggtgcccatgtaactgaagtagctgctctgttaatacgaagaagtactaacgtgggcttgtatgtcccatcactcaatggctcccaaacgtaagcattacggtcttgggagcaagtcacaatacgaccatgtatggaaatgtccacagcagtaatggttttatcatgatctttcaacgttgcgaataaaacgggaggtgtgttgtttgaaactctatagacaagacaatctgtttcgcatgtaacggctaaaatagatttatcttgagaaaagcaatgagagtagattggcgctttgaccagcttgtagacggcaacaacggacttgtctttagaattggaaaatgacattaggagactctcaactaatatacgtttacttcggcttatttttcctatttttctttgtttctaatctggaagctttctcgatcaagattgctcttatttgaccctttttcattataggcaaggcgcgggcgggtgacaagaagattttgataattgtgcaactgataacgtaggattcattatcaacattgttgttaaagagtaacaaggaaatctaagaaatggttgtgcttgttgtcgaagaagtgatagagacagtgtttttgccagccaattctctttaagaataggcctttcttgtaggattaatggttagtaggttttatcagattccaggtacgcatcggccatcgtcggcaatatcttcttcaaatgaatcttcttcactgttgtctgcaaggagaataagtcaaacatatttcaattatcaggcgacccctgaatgccaaaaagtttcctctaagtatgatcctgataacccaaacaaagataagttgggaacatacgatggggtatttgtgcctactgctttaaacgtattgtctatccttatgtttcttcgttttggcttcattttgggtcagttaggtattatatgcaccatcggtcttctgctattgagttacactattaatcttctcaccacgttaagtatatctgctatatctacaaacgggactgttaggggcgggggtgcttattatatgatttcaagaagtttaggacctgaatttggtggatccattgggcttgtctttttcttagggcaggtgttcaatgcaggtatgaacgcagtgggtattatcgaacctttactctataacttgggttattctgctcaaggcgagccacctgcagctttgggagagctactaccaagagggcattggcacgaatttacatatgccacggtcattcttttcttatgtttttctgtggcttttgttggctcgcaaacagtgtcaagagcagggaatattctttttttggtactggcagcttctatattttccattccactttctgcattgataagatcgccattcactgaaggcggtatcagttatacaggtccttcatggcaaacttttcatgataacctgctccctcacttaacaaaaggtgcagcaggttcgttactcaaaggtaaggaaacattcaatgatttatttggcgttttttttcctgctacagctggtatattcgcgggcgcaggaatgtcaagtgaattgagaaagccctctaaatcaattcctaagggtaccttatggggtttacttttcacttttatctgttatgccgttgttgtcttctccatgggttgttccattcccagaagatcgttatatgatgaagtacaaattatacagacgatcagttccgttcagtgggttatattcatgggtgaaatggctacttctcttttctccatcatagtggggatgctcggtgctgcttatgtattagaagcaattgcaaaggataacattattcctggtttggagatttttgctcattcaccgttatattcattgatttttacttggattctaacacagctatgtttgttttcagacgtcaataaaatcgccacatttatcacaatgacattcttaatgacgtttgtggtcatgaatttggcgtgcttcctattaggtatttcctctgctcccaatttcaggccctctttcaaatactttaacaggtatactacagcaattggcgcattactttctgttgttgcgatgttaatagttgatggcatctcagcgtctgtcttgtttttggctatgattttgctatttttattcattcattatttttcaccaccgaagtcttggggtgatgtgtctcaaagtttaatatatcatcaagtgagaaagtatttgcttcgcctacgtcaagacaatattaaatactggaggcctcaaatattgctgtttgtagataatccaaggacgagctggaacttaataaggttttgcaatcatttgaaaaaaggtggtttgtatattttaggccatgttgcagtaactgcggattttccgaagcaactaaatgaattaaaaactcagcagaaagcttggatgaagatcagagacatggcagcaataaaggcttttgtccaagttgggactggtccctcccttatatggggaattaggaatgtttttattggttccgggcttggaggtatgaaaccaaacattactgttgtcggtttttttgacctcgaaagttatagaaagcacatcccacaaagtcgcagccaaaataaccttcagaaacaggtggaaataaaagctacagtgccacgtagtacatgctctgatgtcaaaatcaatgttccattgcctacggatgagtgtaaaaatgaaaccaaagttaatgtacaacaatgggttcaaattgtagaagatctatcactgatgcaatccaatattgccatagcgcatggattcaaaaatttagagataccgaacaaaagggacagctgctttccaaaaaaaactatagatctttatcccatccaaatgtgcggaaaagttgaggcaaagggtgaccagcctgcggctatcactactaactttgatacgtatacactgattctacaattagctgccattttggttactgttcctgaatggaagcgcacacattcgcttcgagttattttatttgtggaacaagaatatcatagaacgaacgaaactcaacgaatgaaaaagctattacaggttctaagaattgacgcagaggttttggtagtatctttagatcaattcagagtatacaacacaattgtcaagggagacccaatcgtgtttgattatgtcaactcgaaattggccgataatgaatggtggaaagatttggttgaagctcgtgatacattaaaaccgaagcggaggttttccactattgaacctcaaacgatagcaaagcaatttacacaatcaagaaaatatacgtctggggttcagaaattgggtgtctcatttacaatgaatacgagaatgccaactaaccgcattgataccccatgcgagagtgaggactccgatttggatacagatcttacgtcaattcgtgatgccttctcggcatcgactaatatttcagtaggtaaggacttaacgaccaaatcgaagaccggttccgacagaacaaatttactcgtaaagaatttacaaagcgatgtgtcaacacagtcgttaagacccgttttctcgagtaatactttgccgaggacgagagtcgtggaagatggcacgggtgaacagccgacactgatcccaattgccgaacctgacctttcgaatgggaacggtactgggagcggtattggcaacggcaacaaattaaagaaaccggttcttcccgaattatcaccttgttgttcaaaagatagtttagtcacagcgatgcaaaatttaggtttcaatgatcttcccagcactgctcaacatttggttctgaatgatgtgatgacacaaatgtcaaagagttcggatttaattttttcaaccttgccagttccagctcttggaacacatgaagatcacgatgcaagtttacaatatgtcgaggacttggatatttggttggagggcttacctccatgcatgttaatcaattcgcaaaccatgacagtaactactgcattatagaataacacatatatcgttatgcatttccccagaacttatttactacatatagaagtcttgtaatacggccgaaatacagatgctttatagtagggttattgtttctattcatttttatttcagttgggctttacgctttccggttcgatatactgttttaccttacggaatgcaaacatggtatagaaatatgatgccgcttccttttcatccccttcaacaccatatctaccatcagatctttgtaaaccttccctcattttaggcgaaaacctctcaatccatttgggaatttcttggacaaaaaatttattaaaaggcatttgcgatactagttccaaaccgtattcatcagccaaacttcttaaggtttcgaatggcacaacatattcaggaacattatctatagcatcttctagccaataagtatacatttgaccataaggcgatgtgaactcataatcattcttttggtatgaattattctcaaatgtcactttataaatggagtttccccaagatggcttttccacttctttgggaaatttattcagtttataacgaatgaattctgaatctggtatcgtgccaaaaaagtgaccaccaattttgagtgatttggcgacattcagtaaagctctccttgctttttcttcggtctcaaaagcataatgcaagcaaaattgcgtcgaaacgatatcacacggaaatctacagtctgggaagggctctactgcaacacctaatgattcgccaaagcaatccccagtaattagcacaacttggtagtccaaatttctcatggaccggtatctcttatgagcttcttggatagaggcattggaaatgtcaataccaataaactgtgaaatacctgcagcaccatattttcttaaatcaccacctttgccacatccgagttctaaaacgacatctccaggttttgtatatttgtcaattaacatatacttaatcgcattgttaaaattacgaagcttaataataggcgatagattcctcttagcgcgattggcgattattgtacgttcattatagtgctctcggacaatctggtcaacatttatggatctatttgcagtcatctctatttcatgtctctttagttgctcttctctcaatttttgagcacgctgtttgcgtaatctttcctcttgatcatacctttcatgtcttctcttttggattttaaacccggattctgcctcaatgggtagatcagacaccttagaagtaaggatagagctgctttgcaaaactggtaatgatccattaccatcaccaggcgcattggcagtaactttggagtctttttttgagactgtggacgattcatcaccagtaattgagccgtactgacggtcatagtcttcttgtgacatccatattggcttctctggtttggttgacattctacttttctaagacggataatggacgactccacgttgtagtagttgtcacattaatcggaaaagtgtctcacatgtaaaggattaaaataagaaatcttctaatttatgttgaaatatcttgatttaccattacccggattagatgaaactaattaaagtcatttagagcaatggaccaaactaaaggtattagagttctttctaatataatacagcgccaaataattcgagaagggaaatcataacgctgttgccttgggtttatttgaggtatggaaactattgattcgaagcaaaatattaatagggagtctttattggaggaaaggaggaaaaaactagcaaaatggaaacaaaaaaaagcacaatttgatgctcagaaagagcatcaaacttcacgcaatgacattgttactaacagtttagaaggtaagcagactactgaaaagtttacggaaagacaggaacgtgtaaaagaagagcttcggaagagaaaaaatgaatttaggaaatctgacgaacctgtatcggttaagccttcgaagaaaaagtcgaagagaagtaaggtaaagaagaaaatatccttcgacttcagtgatgacgatgattctgaaataggagtttcttttagatcgaaggagcacattcaaaaagctccagagcatgataatgaaaaagatccactggatgagtttatgacgtcattgaaggaggagaaaatgagtaatagtaaaggcatgtacgacagaggcgacattcttgatgtagaggatcaattgtttgaacttggaggaaccgacgatgaggatgttgaagataatacggataattctaatatagcgaaaattgctaaactcaaagcaaaaaaacgtgtaaagcaaatttattactctccagaagagcttgagccgttccaaaaaaatttttatatagaatctgaaacagtttcctcgatgtcagagatggaagttgaggagcttagacttagtctggataatatcaaaataaagggaacaggttgccccaaaccagtcacaaagtggtctcaactgggactatcaacggacaccatggttttaattacagaaaagttgcactttggctccttaacgcctattcaatcccaggctcttcccgctattatgtcaggtcgtgatgttataggaatatcaaaaactggctccggcaagaccatctcctatcttttaccattgctaagacaagtaaaagctcaacggccattatcaaaacatgaaacagggcccatgggtttaattctggctccaactagagagctagctttacaaatacatgaagaagttactaaattcacagaagcagatacatccattagatcagtatgctgtacaggaggttctgaaatgaaaaagcagattactgatcttaaaagaggcactgagattgttgttgccacaccgggacgatttattgatatattaacactaaatgatgggaaattacttagtactaaaagaataacgttcgtagtaatggatgaggcagacaggctgttcgatttaggttttgaacctcaaataacgcaaatcatgaaaactgttcgaccggataaacagtgtgttctatttagtgcaacttttccgaacaaactacgcagttttgccgtaagagttttgcattccccaatatctattacgattaattcaaagggaatggttaatgaaaacgtaaaacaaaagtttagaatatgccattcagaagatgaaaaatttgacaatctggtgcagcttatccatgagcgcagtgaattttttgacgaggttcaaagtgaaaatgacggacagtcaagcgatgttgaagaagttgatgctaaagccattatatttgtatcaagtcagaatatttgcgacttcatttcaaaaaagctgttaaatgctggaattgtgacctgtgctattcatgcaggtaagccatatcaagaaaggcttatgaacttagaaaagttcaaacgagaaaagaacagtattcttctctgtacagaggttctctcaagaggtttaaatgttcccgaagtgtcgttggttattatctataacgccgtcaaaactttcgcgcaatatgttcatactactggaagaactgccagaggtagtcgctccggtactgctattactcttctattgcatgatgaactgtcaggtgcttatatcttgagcaaggcaatgcgcgatgaagaaataaaagctttagaccctctgcaagcaaaagaacttcaggaaatgagtgccaagtttgaatccggtatgaaaaagggtaagtttaggttgtcgaaagggttcggcggcaaaggactggaaaatatcaaaagtaaaagagaggaagctcaaaataaagatttggagctcaaaaagaatgataagaggagcgatgacttggaaaagaaaatcagcaatccacgcgaagggcatgacagtgtgtctgagtcttctgcgcttattccgagactcaattatgaactattcaaagagtctacagacgggtcgatcatcttttacgccaaggtttatattaatgatttaccccagattgtaagatgggaggctacaaagaatacaaccttattatttatcaagcatgaaaccggatgtagtattactaacaagggtaaattttaccctgaagggaaggaaccaaagaatgaaaacgatgagcctaaactatacttattgatcgaaggccaagatgagaaagacatacaattaagtatagaattgctggagcaaaaagttaaagagggggtcgtaaaggctgcaagcttgtctttgaagagtactaaatactagtttttagaatttaactcactcgtggtgctatatactttcgtagttagttctgaaatttttagggtggtaatttaaagcatattcaatcataataaaaaaaaaaaaagagaattattaggaaaaataaaaacaaaataatatataatatatgatgtagaaaaaaatcttgaaatttttatcgattcgaataaaatggaatttaaaaaagtgggaaagaaacaatgagaattcataggatataatgaaaggtaaatgctttaaaaaaaaattaagaggggaaaataaaagtagaaaagcaaataaaaacaaaacatggaataaaagtaacttcaaaaaaatttatcaagaaaatggtaggcttgaagaatataataatagttttttagttgatttgagatgtgatatgacaaataaaaaataatgaaataacgataaaaataaggaagggaaaaactgacaatcgaataataatattaataatggtaagtttatcacatcaattcatagggaatataaatttgaaattgttactcttctttctttttttgttctgtagagaaagaaggtgaaaagtgaaggatattaactttaaacacacgttggcttcaaattatgtaattcaggaataggaatatcgttaacgattaaagtttggaattggttcaaaacttcttgcaaaacggaatatttgacagcggtccctgttgttaatctggctagttgtctggaatcacggcaatatggagagtaacgtttaacaattttcaaatacaaaaccattctgccgtcaactggtatggaagaagaagcagcctccgcagcaaattcatcaaatgcaccagaagcagttgctgcttgcaatgctggatgagagtagaagtccattggattttgaggattgttgaacaaatgctctggtgctggagtatccattggagttaaggatggcgaaggagttgcggttctgcttatttgagtgctgttcatgttacttttcttggaatctctatcattttgggtccatgttacagtagcatctcttaaggccgcccaatctgcgttggcaataaatctttgaccaatttcatctgatttgcggattaaatccatccatctttggagaatttctgcattcgaagcatcatcgacagatcccatagactttaataagattctataagcgactattgtttttggaatgtggtacgcctcgtaactcttatcgatgtattctaaaatactgcggtcatgccagacagtgcatttagccaagataatgttaaagaaaggttcatctatatgcttgatgttgttgtaagtttgaataatattttgtaaagtttgaaaaccttgcatcttgtccacagcataattttcaaaaaaaatgtcgaaaaaagtgtcattcaaagatgaagaaataccgtggttgacgtttctaccataatgtaaagaagacttgtaccagatttgatagatgtggttgaaatcacgggtttggctccatatgtttcttaaaaaggatttcacgtaggaaacttgcaagtctatcttgtatggcatttcatcatttaaagccttgtcaaaaaaggtttgagccacattcaagtctttacattcaccaatgaaggaaagatgggtttctatcaaataaccgtatttcatttcggttgattcttggcataatttttggaataatttgagagccatgtcattttcactagcagataaagaggctctgatcatcccaactgaaagatttggatggaagtaattaatcatcgatgaagacttttcatatagagcttgaatttctggataagagacaccattgtcgtataagatgggtaatataacaccgacaactcttggattcagaaaaatattagatgtgtaggtattttgcccattgattgcagctttccatatgtcgacagcttcctcaaacaacaaaagctccttaaacgcagttatcaaatgcatagcaccgtattcgttcagttcgaccttgccgtttagaacgtcttcggagatctctctcaaagatttgcaaagatagtttgtcatttctttgtgaaaggattgagagtcgtaatcaggtttcttgttcattctcgtcaactgatttctattagctctcaacccattgtgaagtaaatgtacaagcttggagacacgatcagaatttaattccggtgtagtgagtagatcatgatacagccccattgctctacctatagaatcccaaaataatggattagcgttagaatttggatgttctgaatggtgtttcatgttttgacgccttggagtttgtgacatataaagagtctgtgaaacgcaatcttcgaaggcacaaaccttatgaaaccatggggagtctgggctaattgaattaccttgattggagttattatacttgctatgattatggttattttgatgatggttacgattgttattgtggtgatgattacggttattgttatgatggttgttactattattgctgttattctgagctagatgattgttgttgttggctccaatgttgccaccaaagtgaggaacaaaatggttggctgggcttacctgataagtagcgagggctggattgttaaaagtagcaggcgtgtaaggaatggcatagttgtgttcatggtgctccatagcgattgtaccgttaaatttcattggatgagtcagcgaattctttgtcggatgtggaacaaactggtttgggggtttgcccttcagtacttgtgtttgctgagctaaacggatcataggatcagatttgcaagatagaaaagcaattagagtaagaaatatcaagctaatcacacgtttttaaaacctcgatccaactatagaacgtactgtattcaagaaaaaaaactgagagaagaatgaaaggaaaagggtttctatagatataaccaatgcgatatgtaacttcagtgctgaacgacaaagtttctttattgccttattttgactttcttcgagatgtccatggcataacttgagcaaggttgaaaaaattttcttttctttttttctccgaaagaaacccgtttcttttggtgcacacacaaagctcgtgcagagtgctgtcctctgagaaattaccgcagaatcagaggatctatgaaattgcctctcttgtacgagcagttcactgcaggcactcgtcccttcacacggaaaaacaatatgggaaaagttgcctgaaagtttaagcttttttacatattatcaaggcaagaaaagaagagaaatttttcgagaaaatgaacaacgaagcaaacaatatgaagaggactgctgctatttttccagttaggtaccatgtggcatgctgtttttccgcagttcgttatgtaaggtggaaggcggtggtgtgtgagacatgccctgtgagacattggaaactcatgcgtacagaaagtgaaactagctcaattggttgagttttttgatggtatacgcctgatgtttttttcgacaacaggtgagtgaaataaaacgaagagcaaaaaaagaagaagaaatttaagaaaaaaaaaaaaaaaaagggaagaaaaacggagctacccaatatcggaagattcgtaaaggccgccatatacacaataggggcccttcgttatatgtgctcgagcctctggatatcgaccagaatgagcagacgcctacgaaactggtcaaggcttcaagtaaaattgctggaatctgttaacacttttaaaagaacacagttcttgacttacttttggtctatgcataggtattatataatacgaggtagtaaaatgagaaaaaaagaaaaaaaaagtcaattgagtatgggcatgaagttacccaagatcatgaggggcaaaccagagacatctctttttaatgtccacatacagcaacaatgaattatcttgcccttgatggggcttaagagcctgcaaactttcatcttctcagatcctctgaagtccctatatgcaactttagagagcgttttgaagtaatcgcgtacactttcatcgtccatgatctctacgataaaagtcatcttgtttagtagctcctctcttgtccatccgcatagaatttcaaattcctcgttgacataagaaatttgaccatttcttcgccaaatacatgtcggggtaccgatttgtgcaataaattttacatattctaatagagttctttggtagcattgctccataaaaatcatgtcctcctcggttaaagttacagaacacgcaatgaaaatgggccggaattcggcaatggaccgacacatcttcaccagatcctgctggttgaatcgatgctttaggtacaccaaaagatggtggaatccaggtgtatgcgaaaagggggcatttatggaggtgtatatttccattggagtagaataacgtaatgaatgttcccattctacattgctcttgatgttggcagcgtctggtgaacagctttccagggatacagagaccaaatggtttttcctccgctttaaggggatagccaactcgggaaatgttaccgtttcgctgttcaagtaatattggtttatgcttgagtcccaattaatttgggagctcttttcagatgggtcccgtggcaataatcttttaaagtttaaggaattatcagctgaatcaacgggcactaaggggaaatggttcgcgaaaagattaacttgcgaagctacaatcttggctgaatttggtcccagtagaatagaataaacgttttgattggaagatggatacggatgtgggggtatgtttgctcgctgttcgctgtacaactggcgaattttctccatttctgtttcttcagggcttgtatttgtgcccgtagggctattgttactgctattgcctattgtggagttggatgtggaattggtgttggagtacaggatgtcaatagggatcttgttagacaatgtgtcttgatagatgatattcgacagaatagagtactcggaatctgcagcattcgataggaatttagctttgtgaactatatgttgtgggctggtgaatttttgctgttctcccatgttatttacgttgaggctactattgctggagttgttataaatgggtatcatgatcttgcggggtggaaggtccggttgtatgttcattgggagctctctattcggtattccagccaagtacttgcttttctttcttggagcgtcaacgcatgtagccgtgaggcccttgctgatacatcgtaagcatggccttttggcctcacatgacacatgcaatctcgaacagttcacgcatgccacgtttgtgttttttctcttttttctcttctttttttcgagagtatgatttgtatttgcagatgtatctgggtcagttgatgttttgtaatcgttttcatctggagtgcacatcacgatgattcatcaatgtattttatttttataccttcgtgtgtctgttgtacccaaaagaaatgataaaaatagctcaagagtatcctgactttatataactagcaattttatctaagagagtaatgccgttgcaccggctcttgtttagtttttttatgtggttactcttttacaatatactaaaattgcaactcatttgcttttttcatttcttttccttcaatttttttttttttttagtctacggctaacaaaaagcataggctcagaatgatagatagatatccgataaatgtcagtaaagacaaagaaatcagtaaaataaacgtttcaccctggcagataggaaaccctatctcccagtgataaactttaattttttttcgtgcatatatatatatacatatataatataaaacaaaatatcatgaatttctatctaaagtagtgggaaaaaatatgtcgttaaaaatgggtataatatccaagcaaagcttttggctttttttttcttgaaatgagtgaagggaaggctcaataagcctagtcctgcatggcatatacatccttgtaaaattgttgattacacttcagttgtagctgccagtaccgcagttgggaacatgaaagtgtggtatcttgacatgagcaaagttgttgcaatattgtatctttccaactattcactaggcgctccgtgaccaagacatgtaactccgacgtaagctcgtcctggtagggatcctcgaataagtcggcattccctagcaatccattacaatggtacaggacgtctaaatcttgtgtattgtttatgataaagttgaccagcggatacatcgaaaatctcaatagcttttgctggagaaaccacactcttagaagctttgtcaagttggggcaggtatatccatgaatgatgaccagcattgttatagctatggattgccaatcgacacaactccaacgagcgatgcactctttgaacaggcacgaggccatattgatgtccgggtcgtcaattattttcccaaggaagcgtatgaattccgtggtcaacgagttcctcatcttattgatgaaccacgtcgtgtattcttgtcggttcaatatcatgttcccgtagcaattaaaccataggatcccgaaaattttgccttggataatatcgatcaaagaggtgctgtcttctggcggcgatgacagcgctgcagtagtggtttcctctgctgacgacatcgaatgacccggcgacggcagctgatctgtaagagcagaggtaactgcagccggattggccctgaaaactgagtaaggcccgtgtttggagcaattgaggttgaccacagatatgtcgttttccaccatattaagcaattcgtccaacttcttgtctatgcgcttttgagtataatctctatttgtcatgctaccaaagacagaggccacagcgttattgtatatcttcaatctccgtacgcttatggtgaatgtattatcgttaggaagcgtagtttccttacttgcctcgtgcacgctgtcttcgcagtcacttgtcgggggtgatagttgtctaaaatgggtcatttgtttaaaccttgattttgagattttctggcacaatggtttcgatttcgatttgcgagcctgtaatgaactgatcagtgaatgcttgcgtactttgtagatgttctcctctaaccacataagtctgatatcgtaactacaattatctccatgtttggcacacagtgaacagattggtctattctcgtcgcatctgcgtttcttgaatctgcatgcccagcacccagtaaatgtcctccccttggtggggggcactttggaggatgacgctactttcttgcttctctgctgcctcttactattgaccatttggttctagtgcggatatatatataggctatatatatacgtggtgaaatgaaatgaaaacgcttttaaagtgtgcagaaattgttatagctctaacccgtagtattagttccccatataattccgaccgagaaaggtgcacccacttgtcatacaaattgtacatatatatatatatatatatatatatatatatatatgtatatattatacctgcaagcaattgcacgcgagtactctgcgtgagtcaaaagactgtggtaaaatggtacccatctgatgcaggaattccgactctttcaagctaaatgccgtttcattttggcacggatgcattcgcagattggttggaaatccgcatacatcaaatgcgccaagagggctgccattgtatattccttttctcggcagtcctgccggatgcatttatgccgctaagacgcagaaccgaatattgggctcaggaaaatatgcagatagacgctcgcccgtgagcgactcatgacgcgcgtgtgctattttggccccggcagtacaagcggtagtcatggtttccgccacacggatctcatacaacagcaatccatttggtttgcctagttccgtacatatacatagatactaactaaatgagtgcatatactcatgtagccgttcgttactagaagaagaagaaaataaaaaacagatgaatagctagaaagaagtaaaaaatagttgcttaggtatatatgactggctacagatcagtagccagcccaaacctcgctgtatgtagtcttgccctttgtctcgggtacacgcttgtacacatatgtagcaaacatggcagcgatggcggcgaagatcgcaaatacgtagccgcccatgaggccgtggcctatcgggaagaggtatccgacgatgaaggtggcaagccagttgcacacagtaccaaaactttgagctgtagcggcatcctgcgggtaggatagctcaccaatgatcaagaaggggatgggtcccagaccgatggcgaatgcggcaatatagacaaaagtggccgtgaccagtaaaaaggatacgctcaaggtgagacctacactgatcagcagcgacatggcggtcatcaccgtagtcgaggcaagcaataatggacggcgcccgacgtggtcgatgatcgcagatgctgctagagtgacaacgacattgaggatggaaatggcaaaatttacctgaatcgagtagtccggtagaatcttgccgatcacttttacaccgtagaagataatagagttgatgccgcaaaattgctggcacgacaagatggcgagtataactgtgcgcggtttcttgtatgagggatcggtaacatattgccatagtgtgggtcctgaatgagtctcttcgcttgactccgggtcgcggttgtgcccatggctacgctgccaatcctgaatttcttgcttcgcttgttggtacgttcctggacgcaacttgaacagagcagtttcagcttccgagacgaatccgtggctcaccagccaccttggagattcgtccactttgagccaagctaaaatattcgctaccgcaatcacggatccggaaaagagaagccacctccagttataggagtctgcgtacttgagtgccaaggtttgggtcagcaggatacctagattgatagaaacctgattcatagatcccatagcgcctctccactccacgggggcaatctcgttgataaataagggtgtgatcacaatggcggtgccgcaggacatgcctaccaggaacctgccaaatagcaactgcaagtaggagttggaaaagaaaagcagcagagaagaaaccatgcacatggccgaggcgcccatgctcacgtactttcttccgtatcggttggcccagttaccggcgtagtacgacccaaacagtccgcctatgctgaatatagacgtaattgcgccgtattgagaatcggttaacgcaatgcattgcttgagtccgtgttgcccaacccaagtgtcatcgtatgagatgttttcgtctggtgcctcaaatctggagcacgataagaattcttgaggcgcattcaactctgcgatgtggtatccgtactggatcgaccccaaacaagcaactatcgtgcccaagattaaatggcccgtaattaacggttttgtttcgcgggaaccaccgttaggcattagtctttcagtttcagccatgacttagtttgttatgccttagtctctgtgttttgttgttgttccaagagagaaagatattcagcaacttttgttctcctgttattcccttaatcaggaagcaactttaagggaaatccatttcatccctcacacttcccatcttttctcggacaaccttacattacgcctacgacgtatgactacacaagcaagttcgttttacagaccgcgtatcattgctcgttacagctctaccaaaagtgtaccgagcactgtgcccagaagctaagcttttttcgctaacatatatatatatttaggtaaatcatttacacttttcgtcgatctaaaagctcatcgcattttttcggtcctgatgttaaaaatttatttcgtttattaaaaaaaaaaaaaacattactgaaacgtataaaagaaaagtcttaatctataaatatggttttatcataattagactgttttactctgtccattggtcattataaagcctgaaaatacccactgaatggtttttttcgcaggagcaaaccttttccatttctaataaaccttctgcactatttttattctcataaaaaacaattgtcaaagaaagcctacataaaaaaaatatgacagcaacgatcacaaataagaaatcatgctctggttctgttgaggcaggaaagacacgtttaacaactgaatggaagcctgaaagccaagtaccccaatatgttaaaaatgagctctctaaaccccatccaaactatatcctggcgtttttgaacgtggtacagcaattaaaaattcagagaagaaccggttatcttgacctcggtattaaagaatgtgaaagcatatcagatcacatgtacagattgagcataatcaccatgctgatcaaggattcgcgggttaaccgcgataaatgtgtccggatcgcattggtgcacgatatcgccgaatctttagttggcgatattactccagttgaccctattgggaaggaagaaaagcatcgtcgggaatgggaaaccataaaatatctatgtaatgctctgatcaagccatacaatgagatcgcggcaaaggaaattatggacgattggttggcttatgaaaatgtcacctcattggaagctagatacgtgaaagatatcgataaatatgaaatgcttgtacaatgttttgagtacgagagggaatacaaaggaacgaaaaacttcgatgatttctttggggctgtagctagcataaaaacagacgaagtaaagggctggacaagtgaccttgtcgtgcagcgccaaaaatacttcgccgatttgactcaatcgataactaaataattatcataaataccaacttttgcgtcataaaagtacaaagtaactaccaatacataatcttcaacgtactgtccataggttgtcgtggccaaagatgatagcgcctatagcgtgtcttccaagtaaagccaaaattccaatgcagaattgcaacttcaagattgtattgcacaatttgtcttccctcatagggccaaaccatactaatgtcaagtttattaacgtcatattagaggtgctaataatctcattattttcatcaaattccaggtcaatcaaatggagacagtatagtaacttcaagatcggtttaaaaatgctctttggcggttcttcttttaagtttgctcttgatggatacattaaaccgtctttttcattaaatttaggtaacctatgtctcgggcaggggaccaatttgaatagctgaggacatgaataaataaaattaacgatttgaggaatgaatagcaaaagcatcgtctttgaaaaatgacccagtataccaacgactgcgaataccattccagcgaaataacaatatgtatctcccacaaacactgtggcgggccaacgattccatttccatagcgccaaggatacacccaaaaatgggataatcaaaacagcggaaaacctatgggagtctcttgtggctaatggccccatcgagaagtacagcaaatcgttcaatagcgctaagatggccaacactatacattggccaacctctaaaccattaacacctgccaggatgttgatggagttggggcaaaaaattgccatcgatgccatataaacataataccacagccccaaatcaacactagtctttttcaaccagcgttccatgaatccgggaataagtacatgcgtaactccaaaatccacataataaaccattagcagtgggatggctgcaatggcaggcaagaaaaacttatgtctccaacgtaaatcaaataaatcatcagcgatacccaagaggaccgtactttccaagcataggatagcgctcaaatattcagatagtttatcatgaggaaaaatattagaattcataccgttatcttcaaccactgagacatcgcgatggcccccacctgaagtggttatgaccatatacttgtagaaaatgaagggaatgtaaatgaacattacaaataaataaactgcagcagggatagcacctattgtttctggaagcaccggacggccaggtttactcaagtccttaccgaataggcctattttgatgaaggatttgcccacacgtggaatcaacatatctgtagctaaatagcctgctataccaaatcccacggccgcaacaagagcagatgggccctgatttttggaatagtagattaagcatgtgataagtgccagtgaaaaaagtcgcaacatatagtctactttttgttaccgttctccgccttgctctacttgataaagtttttatttacatatttcacagttatatacacatgttaacaatttaattttcgcgctgtttagtaaagcatttttcgagattgaggcaatataaaaggaaagggccatatacaggagatgaaggaaacctgtactattattgtattaaacacatggtagtagctagaaaaaattcatgcatcaacctctgtgtttgtattcgtaacatataaatccacaagaaattttttactcatcatccgctaaaaaaaggaaaatacggacgttacttactaaatgtacgacgaacatgtacacaaatcttgactatttttgatagatgcagtctcttgaaatgaccaacgactcagtagtgttttccaagcaattttactttcaactgtttaatattttttagaggctactcggccggccatatctagacaattagtaattccgatgacaaagagtttaaaaccacaatatctgccacacatatcgtgaaaggcattagttccattgtctccgtattagtgcaaagcccctaagccagcctgctttaaaaaatgtgcaggtacttttgttattgttttgatatataaagaactactatttgctaatatgtgatgtagcgcagagaacttgcatttccctgcatggctgaccttgacaagaatacaattagcaacaaaaagtaataattcaaaatgaccacatctttttatgatttagaatgcaaggacaagaaaggcgaatcttttaagtttgaccaactgaaaggcaaagtagttctcatagttaatgttgcctccaagtgcggcttcacgccgcagtataaagaattggaagaactatacaaaaaatatcaagataaggggtttgttattttggggttcccatgtaatcagttcgggaagcaggaaccgggctctgatgaacaaattacggaattttgccagttgaattatggcgttacattcccaattatgaagaagattgatgttaacggaagtaatgctgactctgtctataattatttgaaaagccaaaaagcaggtttactaggtttcaagggtatcaaatggaattttgaaaagttcttagttgattccaatggtaaggttgtccaaagattttcctccttaacaaaaccatcgtccttggaccaagaaatccaaagcctgttaagtaaatgatatctttgtctataatcaagcaattatccggaacaataaataatacatttatagattagtatgattatatatttttcttcagaagcatggtgtaggatatattaaaaaaaatcgaaatataaaaaaagaaggtttaatgagtggtttcgttttccggaattttctctgctaccaactgttcagttccaacattcgacgtatcctcaatcttcgcttttttgctctctactccatcaacgttctccttctcattagcggtctgatctgcaaattcttcccttatccttttaccattttcatcttctttcttcattctatctttagtggcgtcatccaatacaatccctgcgttaaattccttttccaagcattgcagtaatgtatttcctcttctggctagctctacaggtgtcctgcttctgaagtaaaagtctaattcgaataggggacaatctctaatttcatcacgcactaattcgtatacgtcatctctatccaagccatacttgaataacatgagaaggataaaacgatcttcttcttcagagtacgtccttttgttgttagaagaaggaggatgttttaatttcaaatcgaagaatggattcttatactcagacaacttccgacgtaaagcctcttgttgcattttgacacgcttgatcttctcttcttcattctcaattattttcagatatttctcataatcttcaattctttcaatgttagaccagaaggccttagcatatgcgcgaacttcctctagtgttttgccaggggccaattctctcgcaatggcttgaatggagttcctaccgtatttaccagataccgtgatgaattttctaaattctaatttattccaatttgtaaatccttcagactcccaatcagccttcatcttttcttcctcttcagttaatggttgcgagttgttaaccgacaattttaacaattccaatttttgtttcttttcttcttcatctgaaatatcgccatatgctgcttttacgtcatccatggtcggtacataaccagtcttcttcgccgtccacattctttccttttcgtacaggactttcaattggggaggttgtaattgatgggaatggaagacatgaggcttaggcattctggggtgtgatggggtcgaggaccttcctgtattcaaaacatctttataataattatcaatagagtaattttccttacgttcacgtttggtggggttgagcagtagcggacttataatatccctttgtattttcttcttgaaatcttgaccattccattcataggccgaatcttggttgaatttttgcaaatcatcaagacctaaagtttcatattttgcatttaatgacttagttttgttttctgatttcagtaaaagttcgtccagatcaatatcatctcctttttctcctgaaccaggttccggcgtaccagctgaaccggtagatgtaccacttttgaatacatcggcggcaccatgttgaatcatggataataaagcatctttggaatctgctttattttccttctttttcaaagaagtcctgttttgctggataactaattgatctaatcttaacttctgggtagccctttctaaaattttctcttccacggagttatctgtgaccaaacggaataccttgacctgcttcttctgaccaatacgatgcgctctatccattgcttgtaaatctgcttgtgggttccaatctgaatcatacaagacaacgacatctgctgacgttaaattgatacctaacccacctgcacgtgtcgttaataagaaaacaaacttcttagaatcaggagcattataatcatcaatggcttgaattctatcttcgtgagcggtggaaccgtcgatcctgcaatattcatagtttctgaagtagcaataatcctcgagaatatccaataatcttgacatttgactgaaaatcagaactctagaaccttcttccttcaatttcttcaataacttatccaaaacttgaagtttggcagcgttataaaccaagtgctcatccgtagtgtacggtggacctggctcagcaccatcgaataaatatggatgattacaacattttctaagttgcatcatgatatttaaaagtcttgttttggattccttgctgccattagacccgttcacagcgtccagatccttttccaaaatctttttgtaccatttcttctgcatgctagacataccgacatataaattcagttcctttttaggcagtaaggatgtttccacatcgcttttgatacgacgtagtagaaaaggctgtaaaacagtgtggagttgcttgacaattttatcctgatcttcctctgtgctttcagaagaaaaccaatcgtcgaaatcttgtgcatcggaaaagatatctggtaacaaaaaatttaataacgcccatagttcatgcaaattgttttgcaaaggagtaccagtaatcaacagcctattacgtgaggtaaattcccttaagacttgcgaaagcattgactcttcattcttgattctgtgagcctcatcaatgataatatactcccagttaatcttcttaaggggcgacttttctcttataataatttcataagaagcaatcacaacatcaaagtcacaacctaaaagttttttttggatcagttcagctctttcttctttatctccttgcaaaataaaggcgtttacgtctggcgtccatctatttatttctctcagccaattatttaaggtagacttaggcgcaatgactaaaaatggacctggaattttttcaatgtacctaagatatcccagaaatgaaatagtttgcagggtcttacctaaacccatttcatcagcaaggatacccgctattttgttcttatgcagagacaccaaccagttgacaccttggatttgataaggtctcaattgaccattaacgtaagcaggtgattctctgaattggaattcaatgctctcatcatcatccgagtcttcttctttcaataattccgcatcttcttcgtgttcagtctttcgtctacgaacatcttggtgtttgcctttgcctttgccatttgctttattttcttctaatacatctaagacctgcctgaatttgggatctttagcggctttactttcaataaaatgcttgaataaaccactcaaggatagcagatgttcaaatctttttgtagtgccttccagatcaaactttttaccattagcatccttcagcaggtaacgttttttattcgattcaggatcatgtggagggagaccgacctggaacggttttaaattctccaagtactcttctgaagcagtcataattgaaccagatgaaatacaatcgtatttttttttttcttgcaaaaatatggcgagaataattttgaataggttctcatctttgtccttttcattgcaagaattgttttcgtgtttttttctcattctagtatagaacttgaaaaagtgaaaatttgcaatagctaacatataggccataatagggtatttctacatccacctctagctggtttttgcatagctatacatatggactctattcaagaatcagatgtactaaatgcagtgaaaacaaaactaccgccgtgttgtttgagaatattcaggaataagatcatccttgttgggacgtatgatttagataagtcaactggatacaggtcaggctcactggatgtcttcacaatggacctcaaacttttatgttcgaataatacgtatggcgcaatcctagatttgaagttatccccctttgatgatacattgatatgcacggcccattcgacaggtaatatcatgctatggaggatacggtgcacagataaggatgatttccaatcaaacgaactagatattcatgcaattgcaaatctacaactctttgaaaaagatgttctcattgcctcgtgccatttttccccacttgattgtaagaaattacttgtaacaaatacggcaggcgaagcagctaccattgatataagaacactatctgtacagttcacggcatcagcaatcgcgcaggcttactcaaaactagataaaatagattacgaagttcaaggtgcaaccgaaaaagtcattcatgttgaatcgggacaatttttgaaaccccatgaactcgagtgttggactgcggaatttggatctctacagccttttcaagacgttgtatttacaggaggtgatgattcgagaattatggcccacgacttacgttccaaagaattcatttggagtaataatcgtattcatgatgctggtgttgttagcattaagtgtagtcaacctaactttcgaaataataaacccacgtccataataactggatcctatgatgataacattcgttctctggatttaaggatgatgggtgagtccatatttcctggtgcaaatgtccccacagttaataaattggcgtgtgatcttggtggcggtgtttggagatttgttgaatcccccattgatcaggaacaatctcaccacaacggctccgatcggcttttagtttgttgcatgtacaatggtgccaaggtggtgaccatgaatgataattccgatgagtattttcaaattcaacattatctgaagaagggccatgattcgatgtgttacggtggcgactggtcaaattctttgatcgcaacatgctcattttatgataattccttgcaaacatggatagtttagaaaaaaaaattcagtctgcaatatatggactaatatataggctaatatataggctaatatataggctaatatataggccatattttgatgatttcgatagattatgcataaagaattgataggaaggaacttgcctgaacaataatcttttactctatattttctacttattatacatgattcagaagctttgttgaaagggggaaagaccgagcgatataaaattgatgaaaaattgatattacagcatcaattgacatcaatcattaaatcatcattagcttcctgtggatcaacaaactccctgctggctcctgccaatagttctcttctaatctcaggaccgatatctttatggcctctttgacgaacagtttccaacaagaaatctctctgatcctgggtaatatcgttcttgtaacgttgtgcaaatgttaagaaagccttgtgccatatcactgggagtactcttgtagcatcttccccattactaccgtcatccaaaattctaaacctcataaagtaatacacgcagtcgtccaccgtctggtacggtaaagcatattttttatcgagcaatattttgataaaaacagttgtaggtggagagaaaggtagccttaaaagataactcaaggcagctgaagaatgtaaagccggaacagagactttagcaagcacacttcctgcaattgtcgcttcacgtacattacaccctgtttcaaccaatgggaataggaaacctttgaagaaggcacttggtttataaagcgattttttcaccgcacggtatatatgatagtttaaagagtggtcttcactggtctcgatattgtcacggaaacgttcaagtaaaattaggttaataaatttttgagattctttagcagttaggttggatacaaataatttcgttgcttcgtaaacaacgtgtggtgaccattcttccgggttggtcacataaatgacatcttgccaatttcttaaggatgggataaccttgaacaactttggcaacttaccgtgcgtccaagtttttaaaatactacctaccgtagtatatgctttgatgaccttctctggaagtgcaacaccctctccactcttcaaaccggatgaaatattgcctcttgaggtattctgttcattagcaagtggttcatcatcttgcatatcttcaacttgactttccttttctcggatagaggccataatcttgtctgcaagattatagctaccacttaaagagttaaaatcatctgatttcttgaaatattgctcaaacatcgctgcgtcttcttcatcgatttcaactatctcttcctcttctttataatcaccttcgggttcaaaatcggagatgtcttctccaaaagcttcttcgtcttcgtcttcgtcttcgtcttcatcatcatagctcatggtggtgaatctggcttcaaattgcttgtttctttctgattcagcaagttcctcaccttcaatttcatcctgttgttccttggccaactgcaaaatttttcttgatgctttggagtctatgtatccatcttcctcatttgcagcatcgtgatttgcagcatcgttctgcgctagcttctttttattgatttttttcaaggtaccttgagctgcatctaaatcctttaaaagtggatcatgcctctgttttctggctttagtagaggatgctctggccattatagttaatctttctaatatattgttttatctgtaagtcttaaaacgagacaaatcttggatttaaaacaacttagtgcatatttcctttcgtcaatgttgaagaagtgggagctcatcgatttttaaaaattttcatttccgatgcctcgctaaaaaaaaaaaatgaaaaagtggaaaaatatgttctatttcttcccctactgacaccaccaataatacaaccatataagttggtacaatttctccaagctgtacatcctcttgtgttgtgaaatgtctgatttaacatctatcattattgcgtatatagactgagtcaagattataaagtatacatatccaaccacattactcttcatccattctaacctttaatccgtgctctagtaaatactcctttacatcgttaacagtgaattcacctctgtggaacatacctgcacccaagcaagcatctgcgcgggtctttaggaaggcctcttcgaaatgttcgggtacaccggcgccactggatgcaatgacgggaatcttgaccgcatctttaacatgttctatcaattccagatcataaccagaattagagccatccttgtctatgcagttcaataaaatctccccagcacctagagcttcacatgcccttgttaattcccacacaccaaggtctctagattctcttccacctttgattgtacattggtaccagcagtatttctctccattggggcccggatattctgtctcgaagactttgttcttcgtatctgcttgtgaatttacatatactctcttagggtcgacagaaataacaactgcctgagcaccgtatgctttcgagattgtctctattggtgacgttccatctcctctgttacccaactcgtagtatttttcggctgcatagactgcatccgtaccgatcgatactttatcagcaccagatctgaagtatagacttgcaacttctaaagcaggtattttggttccatcaacatcgacaatatccttgatccccccaccgactgtcaatggaacaaagactgtctttgcggcttgtttcagaacctctagcatcggagtatccttcaaaggacaatctctaaaagaagttatattcaaaaatgttacttcatccgcaccctgttggtaatatttctgtgccaactgaacaggcttaccaaggtttctaacacctttaccatcacttttttcacgtacatcgtattgatcacctttagtaaccaccaaatcaccttggtcattagtacgtacatcaagacaagcaataattctgcgtgttagaccataatttgaatagtcattcattaagagttccttctcttccgcactatagtttggaatcggaggactttgttgcttcaaaaaattctcaatgacgttcaaaccagctttacctgatttttcaggatggaactgagtagcgaatatattattcttgttgactgccgcaataaattcctctgaaccgtacttagcttttgcaattttccaaccgtcattttctaggttttttttcttttctgaattcagaatggcagcaaaagaatggacgaaatagtacctcttgtatggatccaatccaaagaataggttttccgagggaatgcaagaattccaacctatttctggtactggcttttctgaatcatcgaacctggacaacttaaaatcaatgtagttcagacccgtactcttagggctttccacggaaccggcaaagagcgcttgtagcccgacgcaaattcccattattggttttccagattcaatgtattctcttatcggcttttcgaatcctctattaaataaattgtcgacgaaatggccataatttccgacaccaggcaaaatcaatcttgacgtgcctgatatgttaaaatcctttggtgatttcaccagttgtacttcgtaacctaaatgctcaattgcattggttagtgactgtaggttaccactttcaacgtcaatcacgtgaacgaccggcattctctttttctttacttgtaaataattaaaaaacctaaactggatactgctacttcaatagctgcctcttttcttttaaaacctgattgagtagtcgtcgatatcaaaggaatatcaacttatgtatgtttcgatgtctgactcttttctcatgaatttttcattttttcatgatcacctaattagccgtggagagagagaaaaataatcccaaagctacgatatgactcaatttttttttgcagaagagtaactgatagtataacatccacgaaatcagtgaaaggtcagcgagctttgcctttaaaaattgagtttctagttaattagtaaatagcgctaaacacaattaaataataccgaattggcagtggtagaggaaagaatgtacgttacatatatcattaaaaaaacatctatttcttgttaacttctcttctttgtctgacagcagcagccaatttcctcaagacgtcttcagtagtttcccaacctatacaagcatcagtgatggaaacaccatatttcaagccggctttaccttcggctgggatgccttggttaccttcgttgatgtttgattcaatcatgacaccggtaatggcgttttcaccgttagcgatttgctcacaaacaacgtcattgacctttggttggtttctgaaatccttattggagttaccgtgagagtagtcaatcattagaccgttggaaccggcaggcaattgagccttagcttctgcaacggacttagcgtcgtagttggtaccctttttaccacctcttagaataacgaagcagtgttcgttacccttagtagtggtgatagcagcaacaccatgcttagtaacacccatgaaatggtgagaatgagcagcggcttgacaagcatccacagcaacatttaaggtaccatcggtaccgttcttgaaaccaactgggaaagacaaaccggaggccaattctctgtgcagttgagattcggtggttctggcaccaatggcaccgaaggagaccaaatcagccaagtattgaggagaaatggtatcaagcatttcagaaccaattggcaaaccgatatttgtcaagttgacaaacaattgtctagcggattgcaaacccttgttgatgttgaaagtgttgttaacatcagggtcattaattagacctttccagccgacggttgttcttggcttctccaagtatgctctcataatgatggataaatcaccttttaattcatctgacaatttctttaatctcaaagcgtattcttgagcggcttctagatcatggatggaacaaggaccgacaatgacaagaactctgtcgtctttaccggtaataatatctatagcttctcttctacctctcttggcagtttccaaagaagttggtgtggctgggatttgcacttgaaggagagctggagaagctaatgggtcgtaacctaaaattctgacatcttcttcagcaccttgatttacctttggcatgccgttggcagcgaacattggagattcactcatttctgatagattcttttgtttactaaatttagcggttaaatatataaaataaacgaatataaagagagactcttctagttattcttaattactcttataacgatgctaaaaatgacgaaagaggaattaacacgatatatagataatataccaatgaaaagaagaagaaagtatgagaaaaagtttctgtattaatatgaaattaaacattgattggattcgatcacgatgtattcaatgagctaacaatgcgtcccgcacatctttttttcaaaatttcaagcaaaattttttcatttcatcgttgagtcatttcgcagtaacgtacaaaatgcacagggtgcagcgggtggggccacgttttaaagtgattctgccatgcctttgcctttatattaagcaacataactgcctgacagtaatgcaactacacagtgttccgtgagaccgttacagcttatgtttacacagcctcatgcccaatgaaagagtgtcaatataaggaatgcgcttgcatatatacgagtacataatttgctgttgatcacgtgattcataatttttttatttatgtgccgatgacaatgttttccatcactttcaaggctagctgtatactggcagttcgtgttcaaaaacctgtgtggagttttaccctagcattcagttatgtcagaagtgtgtttggcatctatgttaggccaattgttattgttttatgcgaattatgtgggttgtgcagctggggtcaaaaagagcgaatgtaattatattgtaaacattaaatctgcacaatggaatcttgtttagcctttgtttttttctttttctttctatttcttttgttttcgattttgtttttgtgtcacaaaataactaatggcgacatcgcagttttttgggcggctgcatactgtttaataaaaagaagttactgctacctcaagatttcttcctaagcactcaagcccatgtttgccagtattgttatcttgcaacaaaatcagacaaatagaatttcccttttttgtttgactaatgttgttttcgtcttcatcttcttcacttaattccgaggtttcacaagtgttctcggaaaatatatctagtagatccactactctgactgaaagttccacacaaagcgagataaggcagcattttggtaatgaagatttcagtggtgaactaccaaaaaaattaattcaactcaagaaattaaaaaatggtggcactacaatcaagaaggctaaggaagaccttgagtattgctatgattcactacggctgtacgaaaatccctatgtaacatcatctgtagataaaaaatgtggttacagcattgaattgtatctagataacaagtacaaaacactaatgttctccgatttacaattgaatgctgactatccgttgtattacgattcctcactggataatatatctacaaatgttgaaagagaaagagccactcctctacaaatcaaaggaaagattaggataaacattgatagagaagaccaggccctcttaatcacttcccattcaatttctttaaaatgtttcacaaaggaatatgcatgctttgtaaattcagaaactagcaaaaactcctatagtgacaaaattatcaaagaacttaatcacacagagttttttgagtcttccacctaccccaaacagcagttgagagtcatacaccactcattaaatgataagaaaattctattgacaaagggcacgtacgattacccattcacttttacccttcaagcaaatactttcccagcaagtttctcttccttctttggcaagacccattttcgaatagaaagcttaacaacaataatgagaataccaagtaaacctaaaaacttactcaaatttttgaagaatgaaagttttacagataagatcattttaacagaagaaattaaagttaaaagagtcctgccttcaacgagtatgcttaagtttgaaacatttcaattaaggtcatacaatactgcaagtgagatcgtagtatcggtcattggaaactccaagttgattgaaattggtatgcctttccaaatgatattatcaattaccaaaacagattcttccattgaattacaggaagcttctttggcagttgcacagagaatggcaataccaagtattgatttgaagaccaagaaaatactacgagagccatacattaaaaagtccgagtatttactaagaactgtagaaagccaaagtttcgattccgacaagaccattttcggattttgctttgatgacgttgtcatcccaacctatgcggatggtctaccgagctggtttaaaacattctactgtgaaccaagttcattttatcccaatcatgctgccctcaaagtaactcatttgcttttgttcagaataacctatagcaggaatgaattggtggaagggcttgaaatgaaaaaaaattatcgtattacggtgaattttccaattttagttggcgatagtgatatttcgaccagctctttgttacccaaatatgaaaaatttgaaaatattagtgatctacaagatgaacccccactatattctatggtagcaggtgagaatagcttatgaatgttcggtacctcagaacaacgcctctattttatcctttttttttttatttgcatgatatacatatactattttttattagtttcttattctactatgtatttacgtaacaataaatttacaggtctctctttttgtaagtatcttgcacgctgatatctataatactacttcacaagttgatcagcttccgagatagacattttatgtatcaagtcgccatgtccgttctctactggccggtgtatattatgatatttcgaccggttctaatacataagcaccgcccactctgaggagaagacatttttacaagaattactagccatattttcccttgtcaaattagagaaggaaaaattacttgaaacatcccgtgtttgggcactaaaagtatatcaataggagctgaagaacactacactagactctcttggcgtgaaggccttattatgtgaactttcgtaggtttgacttttactaccagtatgaaaaaggttagagtttattcaatcaaatggaaaagttttacaactgagctagtgatctccaaatgaggtagcaagtaacagtcgtatgtatcccatacatttatgtatcccatatatttcattacatggtgatgctttcttttattcgcggagtaaagttccttaaagtgaaaaaaaaaaaaagacgaattgacaagacaataatacaagcaccactaaaagacctatcgttattgttgtcaaagtagacggtaaaccatacaagaaacagatttcatagatcaataggtaaagatgttcaagaggcaattatcgactagtgttcgttatctacagcattatgatgagtcgctattatcaaggtactatcctgaaagtcttttaaaatccataaaacttgctcaacaaacgataccagaagatactaaattcagagtatctcgtaacgtggaattcgcaccaccatatttggatgattttaccaaaatacatcctttttgggattacaaaccaggcatgccccatctccacgctcaagaggagaataataacttcagcatctttagatgggaccaggtacaacaaccattaccaggcgaaggtaacattctgcctccaggagtcagcttaccaaacgatggtggtcggaaatcgaaaagcgccgatgtagctgcagggctacacaagcaaaccggtgtagatccggattatatcactagaaagttgactatgaagccgctggtgatgaaaagagtgtcaaatcagactgggaagggtaaaattgcgtctttctatgccttggttgtcgttggtgacaaaaacggtatggtaggtttgggagaaggtaaatctcgtgaagaaatgtccaaagcgatctttaaagctcattgggatgcggtaaggaacctgaaggaaatacctaggtatgaaaacagaactatttatggtgatatagattttaggtatcatggtgtgaaactacatttaagaagtgcaaaaccagggtttggattacgtgtaaaccatgtaatctttgagatttgtgaatgtgcaggtatcaaagatctgagtgggaaagtatataaatccagaaacgatatgaatatagctaaaggtaccatcgaggctttcacgaaagctcaaaagacattggatgaggttgccctgggtagaggcaaaaagcttgttgatgtcaggaaagtttactattcaagctgaaatactatgtacatacacacgcaccattatctctcgttttacataagtaaatacagcaataataatacctgtaaatatctcaacatactcaatcaaatgagctgataagcatattcaatttttcttcatagcaatatttttttctgtccaagttttattttttttccataatttctgatttactaccattgaaaattataaaaggaaaaatattacgcgctaccatttaataagtagaaacaactaagttctcgaatgagatgtttgcactgatacagcgagccaaaaaataaccaaatgactgctactagcgacaaagtactaaagattcaattgcgctcagcaagcgctactgtacctaccaaaggttctgccactgccgcgggatacgacatttatgcatctcaggatattaccattccggctatgggtcaaggtatggtttccaccgacatatcgttcaccgtacctgttggtacctacggtcgtattgcgccaaggtcaggcctggcagtgaaaaacggtatccaaaccggtgctggtgttgtcgacagagattacaccggtgaagttaaagtagttttattcaatcattcacagagggatttcgcgatcaaaaaaggtgatcgcgtagcccaattgattctggaaaaaattgtcgatgatgcccagatcgttgttgtagactctctggaagaaagtgcaagaggggccggtggctttggtagcactggtaactaacttagtgtatatactttggcacacttgtataatgtataataaaatcaggataaatccagtgtgacccggactgaattactgaaactttgaagtgttaaggaaattgtactgccatttaacgcatttacctatcacttagtagcatgcataagccatgggctaatcataacagattgtgatgataggcatcctgtactccttttttttacaagaaaatgagcaaccaggcactatatgagaaactcgaacaaaccaggacgattctgtccgtgaagctggcggaattgataaatatgactacgatagccgatagaaatgatgatgacgagggttcattcgcacaagaaaattctgagctcgctgtggccacgaccagtgtgatgatggtgaataaccagaccatgcaattgattaaaaatgttcaagacttgttgatcctgaccagatcgataaaagagaaatggctactgaaccaaattcctgtaacggaacactcaaaagtgactcgttttgacgagaagcagatagaggaattactggataactgtatagaaacgttcgtggcggaaaaaactacgtaaaaaggcggtatttatctattatttggccaaaaaaaaaaaaaaatacatactacatatacatatacgccataaaaaatctctgcatctatcttatttcccattatttggacaaatgcttacgtgctaatgtccttaccctcgagtcgaatgccgggctcctaatagggtctgtaatcttataaaacgggttcattagtgtctttacgtatagttcgtgtacctcttggtagaatgacctcatattattgtcgtcaataactacgctactgttggctgagttcccatggatcatcacgaacttcatcccactatagctaatataagccgttattgctagtccataaaaatgatcaactttacctagataacaattatcagtattgtttacagctctagatcgaaggaacccaccaccgccattggatccgtttccaccgttcccatttaactgtgaagtcggattaatttgccattgtaaatcttctacgatatctagtgatgcatgcagtatgaacggatttaattcttttaaatcctgaggaaaaccctgtggattttctgcattggtaaactcgatttcatagacaggattgtccttcttaccaataatggcaaaatactgaggcatctcaatgtgctttgtatgttttttctgtattctctattcgtattagtgtttaccttctcttttttttcttgatacagattgatattatttgaaaaaatctgatgagtaaggctttgaagaggtaaaggggatatcaagataaaaaatatacacttcagcagaggagggggaggtactttaaacggatgaaacatgactcatacaaatgagcacgaccataaggctgaacaacaacaaaatggaaggggcgatacaacaacagagactgtaaaccctcagaagatgaaattggttaccaaacttctcattgataataaatttggactaatggacgacttgaattttagtataccattaaccgcttcttctgagggtgtaccaatatcagcaaagacatcagaattgggtacggagtacctcaagaatcaacaagagaattcagtaagcccaatacttccaatatcaagaagtacaagaataaaagcagacagggtgagaatatatttagactattattataatatattagagcgttgcatttcaattgatagctcccagaatcatcatgagggtgttgaaggggtgtacaacccattacaagttattaggaatcgtaaattaaaaaagaagcatcatgaattacctaccagagagttttatactacaaaacaccctattattgccattaagcagttttcgaaaaaacccaacaaaaaaatgccgtggtttgtagatataaacgagaagtatatggatttgacttggagaacttcgcattgggaagaattagtggatcctcaaggtaagctttggttccagtcttatagtccttccaacgaatcgagcggatcatcatcatcccgccggcatcatggacaccacattcatcccagaagacatttacaacatcactccagggtccgtacagctaattcagtgcactcaaacactcaatcactgacaccgaaacgagtcatgaccaatgaagaagacaataataatcataacaataataacatgataacgaagatcgcaactactccagaagctcagatttcaaggaacaaaaaatctgatctcaatttaagtcacattcatttagaggtaccaataaccaatacagttacaaacacctcatcagatcaggggtcattgatcatcgaagcaaagggcagtagctatggaggtgatcgtcgtggaagtagtaataccagtggaagtggtgggaaaagaaattctaaacattatcgttcaaaatcagcaggccccccggaaaacgagaaatcaagaatgaatgggctcgaaaaaatcattagtaaaacgtcgaaaggatggtctagatcaccaaaaaaaaatacgcctgggcttgaaaaacaggtgcttctgaatcccactattagtaatggaggcaccagcagaaggagcagtaataatggagagagtattagtaccaacagtagcaaaagtagcatgggaattacttttggaaacactgaaacttacaagacgccggttgataatgggaaagatgctataatacggcaaagtttgttgagcgaagtgccagttcataccttgagaggtaaaaccagcaacagatcgttgcgagcagaaggtgaacaagctcttgaaagtgacaaagaattaccaaatggtgctgggagtatttacgaaggtgcgcctagggagaagactactagtcaaggtagcgaaccagtgggattagtaagcgattccttacaggttgacgaacagttacagagatactggcatgatacaaggtatattatgagtaccgtagctatgatgcaacacaggagagagacacatgatatagtgaagaggagagaaattgcacgaagaaacgaaattgaaattacacaagatgcagatacaaacattaggaagactgcagatgctttgactcagtatgataatgaattgaataaagttttaaagctaggtaatgactggacatcaaaacttctgaacgactattcaattcgtgtagaaactttgatatcatctagtgacagaattcttagtgatataaatacaacattgacattgaagttgaaaatgtttcaagagaatacagaaaggtatgttacggtgaaagttatgagagcccaaaagatgaccaaaaccatatatcggttgctggaatttggcattgttttagttctttggacaatttggtttttgttcagcgtcctgagaagcattcggttcacaatttttttagttctaaaaatcattaaggcattgctgtggtaatttgcgggtctatgtatttatagaaataaaccatctgcactgatatatgaatatataagtagacatgaaaataactttcatgtagttgaccgggaagagttcaaactctcatcctccagaaaaaggcctctctcagcagcttcatccataatcttttctcttcttttctgttcctcacgataataatttgtctggaacttgagcaattgcttatcagctctgaagacagcacccattgaaatccaagaacaatgataaaaaacacgcacttgagttctgacatttctatatactgatgaaaatcttctcaacagcagcgctgaggcaatactgaagagagcaccttgggcagctcctatacatgatgcaacagtaatctacgaatgagaaagaaggttaattagacttgtgttagcgatttattctggggtgaacaagacagggccagatatattcttgaattttacatacttctttagttaattgtttaacagttttggggtcataatgaatggggagaacgttaccacccatagtagcagcagtttttgtgtcgttggtatttagggacggttggttacagtggcaataattggaaagttctttcacaacaacacaaaaaaggtggagagaataatttgtacggaaaaagttatacctttgcatgtcacgtgaaccaacagaacatggtaatacataatgaagagaagttgcctaagtaccttagctacagtaccaagttctaatctcatcattatcacacatttacaagactatttttgcagcagatggagagatcacttcaaaaatgcgtttatgaaacctatttatgacgaattttttatttatttatttaggtagtttctaaccttctcctcgataatgtttgagatcatagtattcaaagtactatctttctttgatatttggttttccaacgttaatagaatttgcttctcaataatcttcccagtcaaatctacttcaatattaacctcgtcgccaattttcttcaaaggcatgataacattgtcttgggtgtgctttatcatactaatatagaaggctccaccttgcgaaagtgggtcaaccttgattatggtcaaggaagttccatctatacaaatgaatcccttttctactatgtatttaaagtactcttgatctcttaactgaaacccaaaaataattgaattcccctcaggtcttcttgagacaatattagcaacagtgtctacgtgaccctgtacataatgaccaccgaacctaacgtcttgagataccgctctctccaagttgacctgggtgccttgaatccaggaagcgacattacttcgttttatagtttctggtgatatcccaactttgaaggagtcgttattaaactcggtcacagtaaggcataccccatttacggctattgaatctccaacgtgacaatcggtgagaatactccccgcattgccaatagtaatagaaactccttgacctccactttcagagtcatcatatgggttgttttccaaaacagtccccatgcattctacaataccagtaaacattgtgctatggttacgatctcaccaattggtttgacatgtacgttaggaagtaccgtctttttatatcatttggatggatctggaatatgactaatagatagttcaataaccttcctccatggaaattaccgaaaaaaaagaaaaggacggaattggtacccggagagtacttgggcggctactttagttttatataaaccaatatcgaagacagtgatctttttacagcgagcttgaacacaaaataactaccgggggtaatcgttcccacagaggcaacattaatgaatcctgggttaacattaatacctacgcgacaaaaatcaataaaagagattgctagccataaatgaaaaaagaggaaaaaacatgcagattgtttttgagcttttatgtcataacaggtgtatttatagcagtatgaatagttttactagccaatattcattttttttgaatcgatgtaaaatttttggatacaagaaaaattgcacaatgttaaatttctacagaaagctcatgcaaaggatggaaaactgagcattactggcagctttgtggggtagttaaagaagtttattctccgtggttgcagctgtggtggtctttttactgcctttatatcccaattcatccgctttttacccggtccgttgatttgagaaaaaaaatggtactcaaaatagtatggcaaatatactcgatgacatgaataagcggagagcaataatctgtaaagactaaagaaaataagcacgatttggactcccctatttgtcagaatggatagaactcaaacgtttattaaagactgtcttttcacgaaatgcctggaggaccctgaaaagccctttaatgaaaatagatttcaagatacgttgttgctactgccaactgatggcggattgacttcaaggcttcagagacagcaaagaaaatcaaagctaaatcttgacaatttacaaaaggtctcccagttagagagtgcagacaaacagttggaaaaaagagattaccaaagaatcaacaagaactctaaaatcgcattaagagagtacatcaataattgtaaaaaaaatacaaaaaaatgtctgaaattggcatacgaaaataaaattactgataaggaagaccttttacactacatagaggagaagcatccaacgatatacgaatcattaccgcagtacgttgattttgtaccgatgtataaggaactatggattaactatattaaagaacttttgaacattacaaaaaacttaaaaacattcaatggatcattagcattattaaaactatctatggcagactataatggtgcgctgttacgcgttacaaagagcaaaaataagactttaataggccttcaaggcattgtgatctgggactctcagaaattttttatcatgattgtcaagggcaatataatagacgaaataaaatgcattccaaaaaagggcacagtatttcaatttgaaatcccaatatcagatgacgacgattcggcattgagatatagtatactaggcgataggttcaagtacagaagtgtggatcgtgcaggcaggaagttcaaaagtcgtcgttgtgatgatatgctatattatatacagaattagtaagagttattacgtacttccatttgcttcctcttcataagagttcagtgtttcctgaagttgtccctttatcatttccaatagtttgggatcctgtaacttagaccgtacatagacatccaagtcaaatttcttctcaccatcaccattatccccctccattttactacccagctttaggtagttgtccttgaccaattgtgattcaatcaatgcactggttagccctctgtttttaaatattaattcttcatcttcgttaaccatttctttaacagtactggcaactcttttccgaagcgcttgttcaaaagattcactattctcttctgtattattccatgggttagacaatatttctcttttcaacttgtcaaaatgtccctccttcttatacttgtctgatagtcttttactatcttcttgattatacgccattttttggatttgaaataagctctactctcttatactgtgtttcagcttcgctaaataaagaactgattttcttacgtattatttctctagtatctctcgttttcaagatatagaaaaataagacaaaaaaaaaggccatcatatttatacaacgaaaagtgtttaatatggaagcagcaagcggtatatgaactcagttttaaggtgtagtttattttatagtcatgtccattgacgaggctgttgccagatatagagatgttataggcaatctagcaactggcaatttaaggcggattgttatacagtcagaaaaactggcccagatcattgcatcttcaaaaggtaccgttcgtttccaccataaaactcgcagcggtaaaacagtaatatacaaatgcatcaaaaaggcgctgctttccagtgtcgcgtctctatcgtcagagttttcctcagaaacagatgttcagcaattcctccatttaaattacatatatcaatctcacttccaagctttgagtggacaaataaacaaatattgcggcatgaagaaatactacgagttaaagtttgcagcaatcgactacttagaaaccgaagtccaaactaccgggcttacactctcaagattctgggtggcatctttagatgagttcattaaaaaagagcgatggccagataatggatctaactttcaaatcttttacaaactaatggctgagtattcgtcttggaaatgggattctgatgataaaaggcaactccagttcatgtacgaatttcgaatgaaactcaaagaatgtttggtgaaattttacgagaattttgatcttcaaaaatctagcgatcctctgaaagaactcattataccttgggaaaagattgtttatgtcgccaactgtatcgatgcattcactggagagcaagttaggatcgacggtgctgaattaatctggacatccaaaaatcttgtgttctcttcgatttcttctgccgttcttagattaaatgaccttcaaaatatgttcagcgcattccggccttatggggaagaagcattagttcaagactttgcgcatatacgatctttaaagtgggatagtaatgataaagttgaaagcttaattcgtgcccttatttttaatgatatgtttccttatttcaataaggaacaggtagatacgaaggcagatggtatattctttttgcgcttactgagaaaaaacttcaaagaacacattaatgacgttaaagattttcatattcaagtgataaagtacttgaattcccaatttaaaaataattacagcacattgatgacgtcatcgaaaactcaggatagaaggaaaagtcataatatgccttcttctatcttagacgatggtaacaaaattggaatgcatgtttcgcctatcgatgaatactcacattttattgataatgatgaaccgttgtggcgagacaaagtatatccaaagatttacacaaatgagcaaacacctacacctgacgcatcagcaatatttgattctcacaagatatatgcaattatatcgctgctgcgatattacttacctgagaagagaaagttttttcggatttattatctgcccagtatttttaaaaggatattatattacggtgcaaagtttgctcaactatatttcatggaaggttgcttggaacggctagtaatagaatctctccaaattctagaaccctctttggtacatgcgataaataatttgatcaagtctagcatagaatcactcaaaaatgtaacagtgacaagtgatgacaaaacttcatctggtgtcattattttgtcctacaaagaatttaagtcactatctgaagttaacaaagatttcaatgaaccattttggcctaaccaatcaattgcgaatagttggccagatttcgcgaataagcaattaaagaggggtcaaattttgcaagacgcatttgcattccacctttttgaaattgaactaccaattattatcgatactacaagaaatacgcatttgaaactcgtttccaacatgtgtactacgagcatattgtacttatataatgaagttgattccttatcattaactagcatacaggaaaaattagctgttttaccgacaagtaaacggaatgaaatcttattgtacaatttgaacaggctaacaaaattgaaactattgttgttgaaagagaacgaaaaaggacaaaagttttacgcatttaattttaagtacaaaagggatggacagaaaacatcattaataaggttaatttaacaaccgtgaagacagggagttggaccttagcaagttttgtagtaaattattatggaatagtacaacagaatttttttttttctcaatatataattttcctttgtttttacttaaatctgataacagcgtcaatgtacatacaagtggaaattaaagacggaatgaaaatatcataagtgctatgtttattcaggctcaaaagcttgatctgaaacctctaataatacttccattgccataatttgaaaatttacatcattagcgtcatctggatttgcaggcgcaatagttggaccccaaattatacaaagagcccttaaattcattctgttttgggcttcatgtgccaacactcttttcaaatgaaagacaagagcccttaacgtccagtattgtgcgtcggggaggttatatattagtccgtgcataaaattttttcttgttgttgggtcttcaatttgtaaacaaaccttgatctccgatgatagggcctttggtaaaacactatcaggcagcgacgcaaaaaaagttttcagcagtgatcctactaaataaatatccgaatcagaatgtggctttgatggtagaatcatggaaatgtttgcgggatccttatcaatttcctccttcaacttgctgacatcaagtacatttgccgattttctataaattccttcttgatcaagcccaaatttatcaataacgtatatgcattggcgcactatcgcagggaccatgtcttgttcgaattctatcagtgattctagcggtacaccaaatgttttgaaatttttttgaacaccgggtggcatattgttgttagtctgaatgtgagaaatcgggcgatccgagtctaaagagttaatcaattcttctggaatttgtggactattgttgccaggatccagggtctttgttatggatgatgtggtgtcgcttgttacaatggaagaagacggtgacatagcgccagccgcattgctagtggaagaaatagatgaagccatagtaggtggtaactgcttgttggtatttaaggacggtgtagcactgttaagattagcattcggaacagcggcagtgttactactactgctcaaaaatggagattcattatgagtggatatcattctcttcgggatggagtttcttgaagggtccacggcaaactttggggggctcttatttttctgaccatgattcattgatggatgctttttgtatgatacagggatcaagtttttgttgatcagtagggaatgttttcctgtttggttatacttgttcaaaaaactgtaaagatcacgttcattggaaacagatccagcaaatgatttcatagatttggtggagtccaatgggcttattgtaacacctgtattcagaaccaaattttccgtccatatcgtgtacttctgcaattggatagtcatcgctgtgtctatttctaaaatcaaatcttttaattcttgaacaattctaggtctctccttcgttatgaatgtgtttctcaaagaattagaatgatctactttttgcttatattccagatcggcgttatcgatttttcttaacaattcttcttcttgttccttcgtagttttggaacctctcaaggtcagctttgtttttgttgggtcagtcatcctcaatttgtcccaatcttggcacaacgaattgtaacgagattgcgccttttctgcgctgtgtatggcatcagaaacatccttttccagccttttgctgttctccttgacagactttcttaattttgtcattgttaataaaagactactaatctcggagtacattttctgcaaggcggtgatataactctgctttacttgagccatcttgccatcgaatcccaaaacttcgtgaatcatcttttttaaggatgaatttgtggaaccctgaatgttgaaaaagtgcttatattgcttggagagctcctgaacgtgctcttcttcgaaggcgtatttctttctaataaatttcataaactcttcacaagtcaacaacgactgctttaaacggctcaacaaagcgttaattgccacatcggaatttagcaccttcttgatctctggcgtgctaaaaaggtgcgccaaatcgtcggtgccaccatcgtgcgacgacttcgcacttactgtggcactagctggtttcttcgcagtctcttccatcttgtctatatcacttctcttttaatcttccgagattgtatgtttttactttacatactattttgttcacattctttattttctgggttctttttccatatatatcgaaaaaaaagtctatataatggcacaaatggtgaatgccagcacaagaaaaggggcgtatctatataaatctatgcatccttgatcctagtttggcatgggcttgagtgcgtacatcctcactgggtacaattctcttggtaagccacgttgtctttcactggcgatgagctttaggccagcttcttcgaagatttgcctgaacttagcatctgaccttgtgaccgaagaatccgtttcgtcgaaatcatcggtatctgtaggtgtgttattttctttgaccacgattgtcccattaggttgcaaaccaacaatacatcttttcaggaatgcgacgagttctgcatctggcaggtgtcccacgcaccattggcaccagatcagccagtacttgccggcatcgggggtccagtcctgcatccctacttcatatatttgtccaatttggcctttgtctttcagctcagccaattcaacgtgcatttgctcgataaaaggctttaccggttctacaaggtctatcttagcggcgtgcttgtgaagcatggtcttgcttacacgtccaatccccgcaccaatgtctacagcgtacttcacgttgttctcctgaggcagcatcctcgacttcagtttacgcaggaagttattggatcccaggacatccattgtgggtactactgtaccttctccgtatccacctagaacaccatccacagtggcgtccacatccgtccaatagtcgatggcatcttcgtatttgatatgggaatctgcaggcacgtccatcgttgttgtttatgtattctttcttggagatgctcttgacaccgatgcacattaccagagtgaaaagtactgattaataattaaatttttcttttgatattttttctgaatataaagttctacacagagtcgttacaataggttatatacatgaggatgttcgttacagtaggagaaatagaaagctcgctaattcttaccccaggagtagatccaatcgacagagtttcttatctgttcattccaaatatcttttatgctctcccccatggtcctgctccatgcagtgccatcatccgtcacaactagcttgcggttcctggtctccccaggtaccacttcttttctatccaccaggtcctgtacctgatgatcttgtttcaaccatgtagcatcgtgatcgtagaagtagccattgttactgtatcggtacaggtaaaaaacagaaccgattactcccacagagagagtccacttcacagatcttgctaacggacccaatttcgacatgattctctccgttatctgctggttcttagtccactgtctgttctgtcccccttctgtccaagagatagaatataaaaaagactcattatttttttttaggtacttcgcttattggtggtcaatgagaaaaaaaatactaaaagccatcgcctcttggagaagagcaaactatcaaaaatcatcaagccgacatttccacatcgagtctcatagtctttcaatcatgtttcccagagcttctgcattggccaaatgtatggcaactgttcatcgtcgtgggctactcaccagtggtgcacaatcgctagtctccaaaccagtctcggagggagatccagagatgtttgacatcttgcaacaagaacgtcacagacaaaaacactctatcacccttatcccatcagaaaacttcacctcgaaggccgttatggatttgctaggttctgagctccaaaacaagtattctgaaggttatccaggtgaaagatactacggaggtaacgaaatcatcgataagtccgaatccttgtgtcaagcaagagctctggaactgtacggattagaccctgccaagtggggagttaatgttcaaccattaagcggggcacctgccaatttgtatgtttactccgctatcatgaacgttggtgaaagattaatgggattggatttgccagatggtggtcacttgtctcacgggtaccaacttaagtcaggaacgccaatttctttcatttccaaatacttccaaagtatgccataccatgtcgaccacactacggggctaatcgattacgataacttgcaagtattggccaaggcattcagaccaaaggtgatcgtggccggtacttccgcgtactcgagattaatagactacgctagattcaaggaaatttcccaaggatgcggcgcatatttgatgagtgatatggcacacatatccggtttggtggcagccaatgttgtcccatctccatttgaacattccgatatagttaccacaaccactcacaagtccttgagaggcccaagaggtgctatgattttcttcagaaagggtatcaagtctgtcaccaaaaagggcaaggaaatcccatatgagttagaaaagaaaatcaacttctcagttttcccaggacatcaaggtggtcctcacaaccatactatcggtgcaatggcagtggcattaaagcaagcgatgtctccagaattcaaagaataccaacaaaaaattgtcgacaacagcaaatggtttgctcaggaactaaccaagatgggttataagttggtttccggcggtaccgataaccacttgattgttattgacttatccggtactcaggtagacggtgctcgtgtcgagacaattttaagtgccttgaacattgctgctaacaagaacaccatcccaggtgataagagtgctcttttcccctctggtctaagaatcggtactccagcaatgaccacgagaggatttggccgtgaagagttttctcaagtcgcaaagtacattgattctgccgttaagctcgctgaaaatttgaaaactttggaaccaacaacgaaactagatgcaagatcaagactcaatgagttcaagaagttgtgtaatgaatctagtgaagtcgctgctttgtctggcgagatttccaagtgggtcggtcaataccctgtcccaggtgatatctaagtaattatgatttaaaatcaaatactttatgtattaacatatacagccactgccgcttttttttttatttatttccagtatatttccctgttcattgttctttgacaatgtcttgaattgactttcgggaaccaaactgattattattttattcaatgtatcgaaattgtaccctgtctttgcacttacggccacatacggcagaccctgtaactccgccggtatagtcacttcccctgaatgctcttcgcagactaaatcgtacttattgcccacgataattacctgcgttccctgagcacggtcctgtaaatcttgaaaccatgtctttgcacattgcagactggatacgtctcccaattcgaatacaatcaaagcaatattcgcatctcgataatacattggcaccagtgatttataccgttcctgacccgccgtgtcccatatctccatatggatacgtttctccgtagaggagtcgttagaaggaacctcgattgtcttggtgatgaacgccgcacctatcgtagccgcatgttttgctagaaacttacctgatttgagcctagtcactatactggttttccccactgatgaatctcctagcagtaccactttgatggttgcttccatatcgtattcctccgtattttgtgctacttgtatttcctggagtaattttactatcattgttccttaacgtgaaacgtaaggctaaaaaacaataaacgacaaaaaaaaaacaaaaaaatgaaaaatgcagaggagtttctctgcatttactggaagcgattaaataagattgcctcaagaaaagaagttatcggtataatcttttgtaggtaatgaagtttacgttagaagaccaagttgtgttgatcactggtggttcacaaggtcttggaaaggaattcgccaaaaaatattataatgaggctgaaaacacaaagattattatcgtcagtaggtcagaggctagactgctggacacatgcaacgaaattaggattgaagctcacctgagaagggaaaccactgacgagggccaagtgcaacataagttggctgcgcccttggaccttgagcaacggttattttactacccatgcgacttgtcctgctacgaatccgtggaatgtttgttcaatgccctgagagacttggatttactccctacacaaacgttatgctgtgcagggggggctgttcctaagttatttcgtgggctaagcggacatgagttgaacttgggtatggacatcaactataaaacaactttgaacgtggcacatcagattgcccttgcagagcaaaccaaggaacaccacctcatcatcttttctagtgccaccgcgctttacccatttgtgggctattcccagtatgcgcctgcaaaagctgcaatcaaatcactggtagcaatcttaagacaagaactgacgaacttccgtatcagttgtgtttatcctggtaattttgaaagcgaaggtttcactgtagagcagctaacgaaacccgaaattacaaagttgatcgaaggcccctcagacgctatcccatgcaaacaagcatgtgatatcattgccaagtcgctggccagaggtgatgaagacgtttttacagattttgtcggatggatgataatggggatggaccttgggctcaccgcaaagaaaagccgctttgttccgttgcaatggatttttggtgtcctatcaaacattctggtcgtgccattctacatggttggctgttcctggtatatcaggaaatggtttcgtgaaaatgacggcaagaaggccaactgagagcacatccactctcattcccgatattccccgtgactctctttatttctttcaagacaaaccctagtggtgtagctatttgtacatgtataagtatatacgaaatattaattataacattattaccacggcgatattttcctatttttattctcttttcttactatattttgaaagtttttcttatgggtaccgatgcgatgaggtgaaaaaaattttcctctttccacttttagtacaggttatgagatgcttctcattagaagtcaagaagagagcatatcagtaacaatacgatgagtagcagtggtgtttatacgtgtaattcatgtgtcctgacctttgattcaagcgacgagcagcgggcccacatgaagtccgattggcatcgctacaatttgaaaagacgtgttgcacaattgccaccaatatcatttgagacatttgactccaaagtgtctgcagctgctgccagtactagtaagtctgctgaaaaggagaaacctgttaccaaaaaggagttgaaaagaagggaaaagcaagcattgctcgaaaagaaaaagaaactgttggaaattgccagggctaatatgcttgaaaacatgcaaaagagccaagagggaaatactcccgacctaagcaagctctctttgcaagaaaatgaggagaacaaggaaaaggaagaacctaagaaggaggagcctgaacagttgaccgaggaagaaatggcggaaagagtaatgcaagaaaacgtacgcaacagagtcgatattccactggaacaatgtctattttgtgagcacaataagcacttcaaagatgttgaagaaaacctggaacacatgtttaggacccacgggttttatatcccagaacagaaatatctagtcgacaagatcggcttggtaaaatacatgtcggagaagattggtcttgggaacatttgtattgtttgtaattaccaggggagaacgttgaccgctgtaagacagcacatgttggcaaagagacactgtaaaattccctacgaaagcgaggatgaaaggttggagatatctgaattctacgattttacaagctcatacgcaaactttaatagcaacacaacaccagacaacgaagatgactgggaagacgtgggcagcgacgaagccggaagcgacgacgaagatctgccacaagagtacttatataacgatggtatagagctgcatctaccgacaggcatcaaagttggccacaggtccttgcaaagatactacaagcaagacttaaagcccgaggtgatactgaccgaaggccaaggtaccctggtcgctgcagagacgagatcgttcttacctgccttcgacaaaaagggcgtgcagactcaacagcgtgtttggcaaactgagaggttcgacaagaaaaggctcgataagagaagtgccaagttcgtcaataaccaaccacactacagagaccaacttctgcagtaattctttttgcactactttttttagtattttgtcgcatatatactgcttcaccatttgtacattagataattcttcactaccccctctatagcaatgttatagtcattgaatcatgctttgaaatgcctgttctaatattctcttcatataataaatgcgtgatgccgggtatttgtgcgcccttgtttggcgcaaaaatctcgaaagtgaaaaaactaataggcttcttaaagcagttatatctacagcaaaggaaatagctgctgaagactgaagatgttggcgcgcagtttgggttacaggttgatatcgaccagtcgtatcttatataataaacccacggttaagtcagtggtgtcgtcgtgtcctgcgggaacatcgcttaacttaaacatatggaagagcggtaaagacgcagtggcactcgaggacaaggagtatccaaattggttatggagcgtattggatagtgatcacgttgtcgaacatgcggctgaggacccagagggacaggctctcttaaagagaagaaagaacataaggaaggcgaacaggcagcgaatcaagcaaaacaatttcttgagccaactttaagcctccgttaataagatcaagtttggtatccttgtaaataaatatgtgtgtacgtggttaaatagtatgtttttagcataatgccttattttgtaccaacaaaaacatgatagttcccacatatcttttcgcctggggaataccaagtgggacaaacaaaacgttaaaaattaaatcctttagagtaccacaaattcgcaagaaacaagatagttgaattgtcaatcatggctaagataagtatgaatgtgcccagtgtaaagatcaaaaacatgccaaaggtaaggttaaaaagcactagaaagactgtctccacgaaaaacatgcgaaataggttcaattcatactcgaaaagaattcgaaggacgctcacaagaaagagattttaggcaaacatgaaacgtatgcatttcataacacacacatatatatattatatattcaaaataaagcataacaacatacatattgaaaagtaaattgaacgttacgcagtttcatcaaataagaatagtattattaaaaattggccggaccaaatatctagaaatccgttactcttccgttaaacgaataatcgccgtgtctcaacgggtcctgcttgggacccccaacttcaccagtcttggggttaacatcaccttcgaattcaggtatggtcttggaaaattcaggcgagaatgacccaatatcgtttttggttaaaagcggtgaattcaaactctcctttgtacgatcgccggtggcctgcgcattatactgatctattgcctcttgcgatgtggcaatcctctgaagtctttcgaactcttcctgctcttctcttggcagcttgggagggccggggatcctttcagtagttatttttcgggtggccatattaaatggtcgtccacgtagtagatttaaggctcccgtgcgaggataccgataacctgtgcttttgatggcgcacaacattagttcttctttttattatttggttctttctgactctttagcaagttaatatgatctgcactttccccattggcccctttatagggcggaaaagagcatctgtttttccggattcttggaacaagaaaaaggaaatacacctatctatatgccactattgtatattactaaataaaatatttaattatatactcatgcgtatgccctcaagaagttcaccaataattctttggtttctgctgttaccttttatggtattcaggatcccaaaacactgcagcagcgtcagtttatcttcctctgtgacgccgttctgttcttcctcgctgaaaatatatctttgaaaactcttactggcaccgtcatttgtatgtaggaagctttcgtaatacggaagaatgatggagtctctaaaacactttaataaaaggacatcaattgacggtgcgtaccttgaaggttcagatagatatccgtcaagccagtagttactatttttttggaagcttttctcgaagggcagtaacactgccatcatgtcgtagtaaacctgttggtaaaacaccttccagattatgccgactcttttcaaagccgtatttacggtatcctcattggcataattgaacacaatctggttctctaaaatgtaaagtgaagtggtaatgaattcctcgatttcggccaaaaaccttgagtgcgttacggcagccttggtttgtgttttcaaagtgatataaaattccagcagccggtcaatatcttctatttttgctggcaattgccataccctcttgtttttaaatagctccacaactatgctgcagtatataccccagatattcccctccagaacaaataactcctgtacggtgaagcttttatagtttgctatcaaggatggcaagtttttcagtaaatcatgtagtaaagaaacattagtcgcgtcgaaagcatcatcttggatcagcgatagagctgtatcattagggttgttgttaatgctagggttaaaggaatatacagattttccagagtcaataaggcctccagtagaagtatggataaactgtacgggtgacctatgtttaccatatgaagaatgcagaaatttactgaatgggctgggaactacgggttcaacgtcgtctttaccaatggaattatgcggcttgtagggtaaaagcttttttgccattttgctaaagacattactgcctttgtttgaatgagaatgtcctgtagacagtgaagattgtaaactgttcacactcatattagatttcgtatgaaacaatttagagccactcctacttatgttgttactacttgtgccggtaataacagtgccgtagttttttgacgccctcctgcttcgatttctcatattatcttttgaattggtgaagatggacagtcgccttttattgccccttgagttggaagaaaataaactatcattagacgtggtgttcccctccattcggttactacttgatgaacctatttcggagtgaccatcgttattctccgtgccttggctgtactcctcttcaatcgaatccgtcgagcgccttgcattggaaccatcatggaatatagattgaaaccccacctgtgaccatctaggagcggcatcatgaggagatttggatgtttttagatgcacatcttcgtcgggatgtgtcagcgcttgcggtactatatcagaagaaacactataaactctagctggtttgcgattagttgcttttatgttcgggttcgtgacgctcagtgagcctgaggtagcacttcttttacgatttaggtctgttgccattgcttgactctgtagtttaagactcgcctagccacttatgcttattgtggtttgtattttttatttactgtcttctatctttctccctttaattttgaccttattttaaagcccgcaaagatcgctgaaaaattgctagtaaaggtcgcatgcaaaatggataaagtgctcttgtcaaattatttcaacaccttcattcgcagtatagtggtatattggattgggtaaaggaaaacaggcgacaccaatattggtttaagctagtagcgtatgcagctctatccaggcattaaaattggttcacctatttctgatagtagtttttttttttccaatcgtaaattttttcttcaatttcgcgatgagctacaaaataatagtagtgcaatctgtatattacttttcaagtatctaactcatgcaagttaggagttccatagcggatatttcactatgtttgatcctctcgatttgtacacccctgatgacatccaggttgaggctttacagttcaatctagcagagagagagccaaaagatccttgctcaccgcaacgtgacgaaatattaacggctgtagatgaagaagagagtgacgacgatgacaccattatcgataatctggatctgccctccgtgaagtatgctccgccagaagttatcctttgtatactaatacttctgaagcccgatagacaagtaaacttcaatcaggagacagggaagaacaaatctgtactggaggtttgcaagagtcatgggctggaacccgatctgctgaaaagacttttgacttggtatacagaagaatggcctaacaagaggttaaactcgttggaaaagatatgcaataaaatcccaatgctgagatttacagtatccaaagaactactgttgggctactatactagtgtattgaaaaaatacaataatagttgcggattgaatgaggaaatcatacaagaacttcttaaggaattgagctcaaggatatccgaaaactgtgggagaacggcccaaccatccatagtaagatattttgaattaagaaatctaagcacttccataccgcttcatgaaccctctttaacggccgataatcttggttggaaaacatggggatcatctttaatactttcacaattagtcgtagatcacctggattacctacataccactaatgtgaacatgttagcgaacagcgacatcaaacagattaaagtattagaattaggagcgggcactggtttagtaggactttcatgggccttaaaatggaaagaactttatggaactgaaaatatagaaatcttcgtgacggatttacccgagattgtgacgaatttgaagaaaaatgtgtcattaaataatttaggagatttcgttcaagcagagatattagattggactaatcctcacgattttatagataaatttggacatgaaaatgaatttgacgtcatattgatcgccgacccgatatattcgcctcagcatccggaatgggtagttaacatgatatcgaagtttttggcggcatcagggacctgtcacctagaaatacctttaagggcaaaatacgccaaagaacgagaggttttgaaattattactaaaagagagtgatttaaaagtagttgaagaacggcattcagagggtgtggatgattggggtgccgttaagtatttatataggcaaatcgttcgcaattagtgggaaagaaacgaacgcgcttaggcgaatagtttttctttataataaaaatcatgcatgctacatagacattgaaatgtgaattataagtacttgccagaccttacatactgatttatacaatttatggagaagaaaactgaatgggccacctcgccaaaaggttagtttttgattcagacaggaatcaatactggtagtacattaaacaatcaaggccgcctttatagttgcgcttatgcaacataatcatctgcaatctgcaatcttagtttcactgcctgtggaataattttttccgttaactgctttggagtattctcgcaataaaggttcataccatacacttaacttttcttcacctttgtccagtaaatttctcaaggcagaattcctataatgcacagtctcaagatctataatagcacctgcgctcccatcacctatcaagctgcccatcacctttggcatctcattgagcagaaattttgaagtgtattcgtatctcgtcaaggtttctactacttgcatttgttctaagtacggtagtcttaagacaatctcagcactaaacttgtttcttatagcattgaaacattcttcatctgctgaaagatttctcaacattccaatgctgtagccactgacgtgaaaatagttttcgaccacatctttatgatattttaccaagtactgcggattaattaattccaaccactcggttattaattttgcttcggacccaatttttaaagaatctttgtccatagtcttgaataaagaatattcatcttcctcaattcgtgacacctctgcgaataactgtaaaagacaatttgtagaaaaggccctgacatcaggatagttctccgtgtcttcaaaaagttgagcaaatactggcagtattttttttacatgtcttaaagcccagtatttatcttgatttcgtatttccagcaaaaacttagtataataattaaccaattcgatgaaaacgaggatatcttcaacggatttcagtatctcttctttagtaaagcaaaatatgatatccttgaactcaggaccgctgatgaattgaaactcaatagtcaagaagtcaattaatctgacaaaagaaaccgtttccattctaccctttacgctcaccaggtatggcaaattattatcaaataatcgacgcctaatcaattcatctgtactcaacctttccaacgctttttcgattgctgtaatgagcttatcattctccactttctcatcaaatagaatatccaatagaatatcgatgatattactggtcgcgaataaaccctttggctgcgaattctcaatgactctacatgctgctacttttaatggatctatttctgacctaagggccttcactaagtcctccgcgctataaacttctagaacatcgtcaaaatcagccatgggaacaagcttgtccacaacgtccaaaaggtaatcgtaattcaatgaatcataggatacgttagacgtcagaaaacgcttgatcgtagccagtagtggtttaacatccatatctggaagggagacaacagtcacaagattcaaagaacatttccttaatagtgtgttgatatcttcaggcaagttatcttcattaagttcattttctaattgcgtaaggagattttccacgtaatttgtttctttctcactcattgctcctgtttcgctgagttcttttgcggtgattatagttgtaaacttgttttatttttaatcccgtaattaaggtgtttatataaacttactcttcaatttttctatatgcatttgaaacagaaaaaaagatataaaaataccagctataacaaaaatccatgtaaataaaattactgtatatttttttatgtaatctaatcaaaaaaaattcacgtctaatactagtcataaatggagttgaagccattaactacttattttttatcttcgtcctttttcttttctaaatggacattattaccattaaaggttgttgggtcttcaggatcttcttgatgatcgttgttaacaaattggaaaacatttggcgagacagaacgtgacgtagtaaggttggtttccgatgggtacctggttccgctaggtgtcagcattggtgatgcatgagcagatgattgaactggttcccgaacattgttgtattggaaacagcttgacgaagcagctccagataaaggtgttgaagacctcacttcgtgacgattcggcttcgatgtttcctcacgttgtgatgttacttcaggatctttatcgttgtgccaccacgtagagaatcccttataaagacggcccaaaaggcttggtccctccatcccagtcacagatagccccgagttttgagtttctagtggtttaagtaataatgcagaccttggagttagttctagtgtctctagcgtcttcaattcatcagaatccttaaatgtcactctgggaatgcccctgtggaatgagtacgggcagtctccatctgtcctgttgacgtccacccattttctaacgtcatttaatgtttcagacgagttgaactcatgttttagagtcttgccatcagtcatcctgatttgcaagacgcatttgctgctgtgcagtttttgtgcgtcttttatgtaatcatgaacatccaatggcttatcatcatcaagggttctgtgatgagtttcatcaagagcttttctttctgcacggtctgccctaacaagtcttataattctttctctttcctcctcagccagctttctttgtttcagttgttcacgacgttggatctctaaggtagtctcagcaatccgttctcttgcatttttcctatggacgtctctggatgacttttcttctctagccaaacctggattggtttccctggacgaactctcaccagcctttttgtctttgatgcctatgcacgccagcaacttctcccaatgtcggtcatcctcgccttgaataatcaattctatctttccagcacgtatcaagtatatactgggtacaactacattaggaaatacttgctcaaataactggaactgctcagtgtctttgaccaacctcaaccaaatactatgttccgctaaagtatctaatgagacatcatctcctttaaaccaacttttcagccactggtcatcccgtgcagtgttgtaaacggccagcacaacgccttccttgatggaatcgtttattgcttcttccacagaatctctaaacagtgcttctaacatttggttacggctgtttggtttagctatccttgcttctttgtaagtgctttcaacctcaacccagctcccttttaaattttcaacattactacgaggcctgccgaagttaataaagagcggctttaaatgtcattttaataattgaatggcaaataaaaacaactacagcttcaaacataagagtatatcataagttgctgtatatgggcagcacgtattactatgagtctctcgcaggtgtcacctttaccccatatcaaggatgttgttttaggagatacagtaggccaaggcgcattcgcctgcgttaaaaatgctcatcttcaaatggatccctccattattctagctgttaaattcattcatgttcccacttgcaaaaaaatgggactcagtgacaaggatatcacaaaagaggttgttttgcaatcgaagtgttctaagcatcctaatgttttgagacttatcgattgtaatgtctctaaagaatatatgtggataattctggagatggcagatggtggtgatctatttgataagattgagcctgacgttggagttgattccgacgtggcccaattttactttcaacagctcgttagtgctattaattatctgcatgtagaatgtggagttgctcacagagacatcaagcctgaaaacatcttactcgataagaacggaaatctgaagctagctgattttgggctcgcctctcaatttaggaggaaagatggtacattacgtgtatccatggatcaaaggggttctccaccctacatggctcctgaagtattatattctgaagagggttattacgcagatcgaacagatatatggtctattggcatcctcttgttcgtattgttgactggtcaaacgccttgggaattaccttcattagagaacgaagatttcgtcttttttattgaaaatgatggaaatttaaactggggaccctggtcaaagatagaatttactcacttgaacctactccgaaaaattttacaacctgacccaaataagagggtgacattgaaggctttaaagttacatccttgggtattacgtcgagcttcattttctggggatgatggtctctgtaatgaccctgaactcttggctaagaaactgttttctcacttaaaagtctcactgagtaacgaaaattatttgaaattcactcaagatacaaactctaataataggtacatttctactcagccaattggtaacgaattggctgagcttgaacacgactcaatgcatttccagacagtttcgaatacacaacgtgcatttacctcgtatgattcaaatacgaactataatagcggaacaggtatgacacaagaggctaagtggacgcaattcataagctatgatatcgctgccttacagtttcattctgatgaaaatgattgtaatgaattagtaaaacgacatttacaatttaatccgaataaacttaccaagttctacacgttgcaacctatggatgttttgttaccgattttggagaaagccttgaatttatcacaaattagagtaaaacccgacctttttgcgaattttgaaagattgtgcgaattattgggttatgataacgttttcccacttattataaatattaaaaccaaaagtaatgggggttatcaattatgcggtagcatttccatcataaagattgaagaagagttgaaaagtgtcggatttgaaagaaaaactggtgatcctttagaatggagaagattgttcaagaaaatttcaactatctgtagggatattatcctaattcccaactgaaaaaaatggagacaaaagaagggttaagatgcactgatcaaaaaaaaaaaaaaattctttctacttattatatatctctctcgatttctagtgtgtcatcgtaactatatattgtttcgagagattttattattgtaattaatttattgccattttgatctattctacatactaacaatcaattcatatcattatccctgtttgagtaatattcgagcctcatcataaaatctaataattcaattctcaagtttcttctttcttccacagatattccgttcaagtcgcccggtgtgaaccctctcaatctggccactaaccttctcgacttttttgaaaaaaagtgcacttttaatgaaggtgtggcttccctagatgtagcatcttcgttaccatctccccccaacaaaggttcgccatctgcttctgtgtgggcttggcctaattgaatttcatggtgtttttcttttccaccaattgtttttggtacggtgtctaagccattctgcgcgttgatatttgtattttctgtcattcgaggaggtgaatctggtggcattaactcattcctttgcaatctctttttcaatttctcttttatttggctctttgacccttgcattttcaaagaattgaaaatgggtatacgaatttctggtaacactgaaatatcagcaacttcgggttgttcttctagacctgtctctttagataccgcatgttccattgattttaaaaagccctcatctctgacattttcttcaacaggtacaaaatcgtcattaatattggcatccttatctcctttaagcggtcccttcaaatttttattaagttcgcatgttccactatcttctaagcgtacattgataccttcttcggtcataacaacttccctagattcttcttcagtgccttgaatgggtgtgctgtccatcctgtcattatttttgtttctactgtttattgcacccacttgatgtttctcttgcgcaaccgttccatgttcatcttcatcactacgcaagtcatcaacttttgatttttctgtctgctttgaactattgagaagtatagtcccactcgggatctgaatgccgtctcctggcacctcattccttactggagaggcttgttcaacattacaagcataatcgttgttttcaccctcattattaggacgggctttcttcacgctcttgtactgtgcaatattgtcttgcgtaaaacttttactgttgattttattcatactttcctggttctcctgtctttgaacatgttcaacttgcccttttccatcttcctttgttatggtttgctggtcaagatctaaagtgacattcaaggaattttcattacagtttgtttccacttttatgctattccttaaagctaacgaagattcttcgttggctatactcttgatgttagtacatataacgtcactgctaggcgacaccgcttgttcctcagaaactaaaacgtccaccatcgtttcatgacctttcgatcttttattttcagaggtaggcgtctctttggaaggtcgttttagaggattatcactgttaacaacgttatgatcaggattcgttttgatagatctatttgttaccgccttcagttcgctagtgagaacttctatcggttggtatgcgttcacttccgaggattgtgtatcaatactttcatgcagctcagtaacatccacctcatcgcttttagtagaacaaatgttgctatgattggccacgtttttatctaactgcgtactcttcatctgctgatctatttctctaatgctttcattatccacttcctctagtgtttcatcatcaattgatctgcttcggttagcatgtgattcttgctgtgaagaattcattattgcagtatttttaagcgatattgaatctgaatctttcgcactaatctgggaagatatttgaattgaggagggaggctctttcattccctgcgtagccggaacctggatatcttgagaatccacttttctctgtaagtttgaaagtttattttcactcccttcgcatggaatatacatcgacttagtgtcaggtatagcttcaatttccttacttgagtccccttgatgaaccacgcccgattcctgtatccactttcctattgtctttaatgttgcattataggttctcttatctttaaacttacgattatgtgatttgatgaggtcaatcaacagattaaccatatcaatagtttgatagttagggtttggcggtaatatactaattaacatggaaaaaaattttttggcggcacttctagaaagcggtttagtgagatataataagactaattcacggagcatatttgtactctttttgtgtttttgcatattagagctaactggatttaagaagaaaactaaaagtggctcctttaatttttccaaaatttggatctctttttgtataataatcttttcaagcaactccaatatataatcatcatctccattttcaattttttcaataactgctgccagtaacttcccattaggcttctccttatacgtcagtaattttaacagtagctctggacttattttgaaaagaacttcgctggtcatatttccgcaaaattcatccaaatgatccgccatattattctttatgcaaaaattcaataggccactgaataatggttcaatgggatttgccatcgccagatgaaggagttctctgattatttctgatttttctaactcgctatcagacgcattttgtaaaacgttctcgatttctgaaaaattttgatttagctgttcaagttgttgacccttcaacagccaacgaactaatgtaagctgttcggagcacttgaatagttttatgtttgctgcaaaatatgaagctctgctacgtggtaacagcttcaataggagatctgaatttagatcagggatggaatttagtaaatttggattggaatgaatacagtactccaaaatatccataaatttgttacgccttaaaaatgggagcagaccggaaaacagttcaggattccctggtaaagaagtttttaacagcgtgatcagatccacgtttaatttgttttcattttttgaaacatagctttgaatgaaataaataaaattattgttcgaccacatagacacatgaagtagtgtaaacaaattaactggaaagctgagcttcaaacataggtccaagaaattttcaatggaattttcattcggaactttgttcacaatattcgccaaactctgaaattctctgaaagatatatttggtggtaataacgttgatccaacccaattttgggcatatacttctgttttcttatcatccaattctagaaacttttctattatcagaaattcagatgtttcgtttcgagctttcctgataacatcttttaaaagatcaagggtcatgtttccttgcgaaataccaactttggaaatttggatattgaaatttactaatgatgaatcattctttcttaaaaacaggtccaaaaatgtataaacaaacgatgaagtaacagcaccaaaaaagtcacgaaaaatgggtgtatctttgttgttttgcgtgacttttaatataagactgctaaaggattctaaatgagtttggtcctttctatcctctggaagatgcttcaaagatgtaaggatcagatcatgagccaaattaacgttagaaatggctacttcaacagtctggaacacaactttcatgattttatcgtattcacgcttgatgatctgcgggggcaggcttgaaatgtcttttaactttacaccttctgaggctataacactcattgggtgaatatgctttttatattttctttccaatgcaacatctgcattctttcccccaattaacaaatgcaaaactgtgaagagtacattttgcaagtgaatcgaatcatatttgaaaacataatcttcataaatcggggttattaggtggtcccaaaatagttcaaacatatctgttgacaaattcttattacttgtaaatgcagtgtaaacaacacctaaaaggtggtagatgatcccttctctagcgcttggatcattcacataaggaagcgtcatttgaaaaggggttcgtaaaagtgacagtaaacttttgtttccttcctgatttttctgtgatattttcgtgcatatgcagtaggtaataattctccaaactttgatggacattaagcgagtcttggggtgattattgataaagcacaggttatttaaatcaaaccaaactttgttagattctgatgtcaaatcataaactctctttccgctatcgtatagtaatccggtcattgaaagccacaaatccattgctattttattgtcatttttgaccacaatatagttttttatctgctgtgtaagaagatgaccaattgtcactttatctaaattagcgctgtcatatgaatttaacggtagtttagataaaaatttttccgggattgtttcgcatactggagatagcatgatacactggtaaatcctttcatgttcatcaacaaaatctaagcatttttttagtagttccagtaaaacaactattgaagttatgagaattttcatggagtaaatttcatctccgataataatcctaggtagtacctcacctggtaaccaagaagttaccgtctcaatcattaattttggatacttgctcaaaaatccccttataagtagcaatttttcatatattaggttgtgactattgatttccattatttcagtgaaagtgctaatgataggtttaatttcttcgttgctcaagaaaaaagtaccaaatttttcgtctctcaagaaagagacttgtgctgttatgattatcttgtttgaattttcatttcttagcgcaccggtggtccacctgtaaataacttttaacttattaaccaaatctggccttttcgttagccacttaacgattttgaaattagacataatagcactgaagaatcgaactatttgaacatatagtctgattacaaatggattttttttttcactactacttaataatgtgtcctgtgctatttgtagatgcggtatgcatatttcaatgatactttctatattcacaattagaatattgaatttctgatcaacctcgttaacatttttagtggttagaatgggtataatattattaaaggttgcgtatacctcaaacctcctcgcgacgtaatcttcagattcttgtcgcaagatgcccaatccgccctcaataatttctttaaactccgaaacactttcattatcaactaaaccatggatctcaccactcacccaatactctaaggcgcgaggatttacccttgtttccttataaggtgatgtgaaaatattaccgttgtgtaatttgtgttgggtatattggagtttattgtaactcaagtcgcttacagtcctcactgaaggcaacctattcctcaaaattgattttcctggtttgcttgatggagagggtttaggtgaggaacctggtatgcggtaaatcggtgatgattctatcctatcagaaaaagctacactttttgtaaccggtgatacattatcactattagaggcagacaactctggaagactttgcattagcctgcttcctgtatcttctggatataaattcttgttaatagctgataaatcaaattgtttattctcgcaatcacttgaagacgctagctttcgcctctttggcgttggcgatagatcgctttgtatatgcatatgagcttgtggagatggaggtggcaagttagttttcatccacggagagcttccattggaataattatcgtgttgagacctacggaggatatgctgatcaattcgatctatcgtatgtttctttttatctgaaaaatctttcgacattgcaaattgaccacaaaaacgattttgcaatggcaatcctgtaataacgttgacgaatatatatatatatattcacttttatctccttaggtactgatgccgacgaattgcctcaaatcgctctaagactgcgttattactttcgatcttcttgctaacgatgagtcgccaataaataaaaaatcgacgacgtcggtcaattatagtaacttctattattgtagtaaatatgacataagaggaaaaacacaaagaactgaaaatcaaaatggcactaatcacctgccttctgttgacttcttgtttcttatcaaaagtagagtatattcacgatgtaaatctaagatagctgtccttactatataaatatttgctgcggcccttttttaacgatttgtaaaggattacagcagttcgttatacttggctgatagcgttaattttgcatacttttcttataattggtaattttcctacgtattatacagttgtacgtatacttatataacaaagttcatgtgtacttcatattaacctcagcgatacccctacagatgatgtgccaatccatagttttgtctttttcgcgattataatgctttttccaccatttgaagagctcatatacgaagaacaagtttggttgaatgataacattaagcctccgtaccctcacaaacaaatacgcacttgccaggtcacactggagatatctcatacattcagctatacaaactgttgcagatctggagactccgaccatacaatgcaccagaactttccctcctgttgcttcggaattgctaataaaatccaaaactttgtctatttggtggaaaagcggatctttgccgttgtcatctagattttcgatctggcaaatttgaaatccagaattttcacttattactacgttgctgccattttcttgcttatcgctgaccacagtatcagctctatttctgcttttattacatgtagtattacctgcaacttcattggtattcgtcatagttattgcacgatgtggccttacaggatgagcaattttatccttattcaatgtccatgaaacaacttcaccgacagaaactatatgcgtaattcctagagacttaagtaaggcaggattttgtgcatgatccagggatcccaaatacaagtgacgtagaatccgggatggcagtgggcccttcaaattaacgaaattagactcaagaggaatcttcataaaaaatatgctactaaaaagctctgaagaaatgtgtaattgaaagcttttatccctaaatttcaatgcattggcatataattttagattacttccattctgcggactaaactcccgcaggacaggttgtaaatggcctaaaatttgcaagtctgatggaaaaaggaaaaatggtcttggatggatcctcaaaagagcgtcttgtaacggaatattaaagtggaatataatataagctgttaataataatgacgtttctgtatatccgtcttcgcaatacatgaacgtcaataattcttgaacttgggatacttgaaatattaaataacaaacattcaaaagaatttccacagactgaatgtttaagttccccaaacctatactacctgaggcagggaaagtcaaatgcaaatgctcttgtgattttgacgcatcatcgtctaataaaagatctagatatgttcggattttcgttaacgacggcatttgcgagtttgacgtacattttatgatcaatttccacacctcttttgtattcggtatgttatacagttgagaaatggaggttgtcggattgtccgtatcataatttagagactttaaatttactatgcttgtattctcttcgaaacggtgggtcagagatatattgttttttttaattatttgataattatgccaatcagtggtgttaccgcaaatcaaccctgtttcctccaatcgtgtagctgaagtcagcttattcaactctaacttctcgcacaaaaccatattcttatcaacgttattgaaacacactatttcactaggtgacgaacataaattcaagggagtattattcttgaaaaattcgttgtctaataaaggtgtaccaatcaaagtttgaggtatatctgtattgaaattctgataagtgcaaataaaaagattcgtcttgtaaagcgatcctccactccctacataacccttttgaacaaacattaaacagatctgtaaaagtagtgcaagggttgtacaattggggcaatttccctcgtgtgagcacgctggcgctgattctgtttgcatatcagtgctgccaccagtccgcgaacaataaattactatattatcaaccatttctatcatcttggcacattgcaggtcgaaccttcggaatagacctctccttccccagacgtcctgcccactccgttttagcgtggtattagacccaaccttgtttctagaataccttttaagttctaatgatagtccacgaggatctactttcagaaatggtaaaatgctatgattgtgacaataagtagcagcgttttccaaagcaacatcatccacttgcaattccaattgtcgtatctgaaactttagcaagttcaaaagttcctttgtgttattgggatattgaaaaccattagaatcatttccagtttcacaggtatcgccctctctatgaaaggaagtgcgaactttccaggactggaagatatcattcacttcgagagaattacgcaaaagcgcagaattgttagcatctgattgcgatttgactattgcaagagaatgaggaaaatcgggtggttgaccaaaggaaatatcatgagcccaggggaacatttttttacattcaggccattctgcatcctgatgtagtcgcataagatcatgcagttcaccaggtgtgattgagggcacttccaaaaccatggttgttgctctagttttctatacccgccccttctacctcaatgacaatctctcttttatggttggtgtttcttttcacttttttacttcttcttgtacttttctttttgaaccttaaaaactcttgcaattatgtttccatgatgcttttgaagtaataatttatttttattacgcgaaattaatggccttaacaactgcctgccccaacagataaaaacaagcaagggtcaaccgtgttgcaaaaaaaatgtccaacttagttaaagaaaaagcacctgtctttcctatatctaaagtaaagaagattgccaaatgcgaccccgaatacgtaattacatctaatgtagctatatcagcgaccgcattcgctgctgagttatttgtacagaatctcgtcgaagaatcgctggtcttagcacaactgaattcgaaaggaaagacaagcctacgattaagcctaaattctatagaagaatgtgtcgaaaaaagagataatttcaggtttctagaggatgccattaaacaactgaagaagaatagcgcactcgacaagaagagagaactaaacatgcaaccgggtcggagcgatcaagaggttgttatagaagagcctgaattgcatgaggatgatggtgtagaggaagaagaagaagaagacgaggtatccgaagaagaagagcccgtacacaatgaagaacttcttgatgatagtaaagatcaacaaaatgataaatccacgcgcagtgtggcaagcttgctgtcgagattccagtataaatccgcactagacgtaggagaacactccgactcttctgatatcgaagttgaccatacgaaaagcaccgatccttagtgttgttgctattattgctatgtaattactattcgatgcaatatgttatacatatacatacacgcaatgagaaccctaaccttgaacttactattttaaaaggacatctcgaaaaagcttagggataattaatattttgtaggttagagctgttatgtagggaagaaaaacaagggctttaaaataataatcacattacacgaataacttaatttgtctttctgaaatggaaaaagaaaaaaatgacgactgtaacattggatgaattaatactgtcattattgatacgttgttaattatagacagaaatgtattcagtacaatagaacagtgctcataatagtataaagggtcacaatgtccaaaaaacaggaatatattgcaccaataaaataccaaaacagcttgcctgtgccacaattacctcctaaacttctggtttaccccgagtctccggagacgaatgcagactcctcccaactaatcaattcactatacatcaaaacaaacgtcactaatctaattcaacaggatgaagatttaggtatgccggttgatttgatgaaattcccaggcctattgaacaaattagattctaaactgctttacggctttgataatgtgaaattggacaaagatgatcgaattttactgagggaccctagaatagatagactgaccaagactgatatatcaaaggttaccttcttgagacgcaccgaatatgtctccaatacaattgcagcccatgataacacatcgttgaaaaggaaaaggcgcttggatgatggagattcggatgatgaaaaccttgatgttaatcatataattagtagggtcgaaggaacattcaataagacggacaaatggcaacatccggtgaagaagggtgtcaagatggttaaaaaatgggacctattgcccgacacagcttcaatggaccaggtgtattttatcctaaaattcatgggcagtgcatcattggatactaaagaaaaaaaatctttaaatacaggaattttcaggccagtggaactggaagaagacgaatggatttccatgtatgccacagatcataaggactctgccattctggaaaacgaattggaaaagggtatggatgaaatggatgatgactctcatgaaggtaaaatatacaagtttaaaaggataagagactacgacatgaaacaagtggctgaaaagccaatgacagagttagctatacgtttgaatgataaggacggcatagcttactacaaacccctacgttcaaagatcgaattaagacgtaggagagtaaacgacatcattaaacctttggtgaaggagcacgatatagaccaacttaatgttactttgagaaaccctagcactaaggaagctaacataagggacaagttaagaatgaagtttgaccccataaatttcgccactgtagatgaagaagacgatgaagacgaggagcaaccagaagacgttaagaaagaatcggaaggcgattcaaaaacagaaggttctgagcaagaaggagaaaatgagaaggatgaagaaatcaaacaggaaaaagagaatgaacaagatgaagaaaataaacaagatgaaaaccgtgcagctgatacgcccgaaacttcagatgctgttcatactgaacaaaaaccagaggaagaaaaggaaactttacaagaagaatagaatattgagaagtgaagggagattgattttaaacctgtagttctttttacatttgtttggaaataaaaaaaccaaagtaaatattataaatatgtattaataaaatatgcattacctcaatgtagaagaaaaagatagtgagcacccaaacggaatccaaaatgcaaaatcgaaatgacacctaaaaattcaatgcttcttgatgattaatgcaccggtttgccagccaccagcagttacactgacacaaatataatcttcaggtagttctattttcgtgggcttaacgaccctaatgtttctttgcccttcccaattgccaatatgtagctcgttaactattttttcagaagggcccaatcctaagcacccacaatcctgactttcaataccccatgaatacaaatgaccgcgttcggttagtgccaccgtgtgatagtcaccacttgcaacggagataacattttcattgatgtctagctccgttaaactatctttatcgacatctccatttgttactttcaaagtataacagtgagtatcggtgaagaggactaatgaagcaaaacaggcgttaattttgcacagttttccgacaatatttaaatctactatctggttcagtccattgtggtacttccatagtttatcgccgttgttattaatgaagaaaacgcagttatcttgtaaacatgcaaagtcgacaatcctggagtctccattaacatcattcgtattcgggacaatctcgtattttgcaaaagcaaagctctcgcccttttgaatagcatctctttctttccatgcaaccaacccgaccttatatatatagcaacaattgaaattccaaccactagcaattttcaaaataggattcgtagcacgactaggtaggttagcaaactcaattttgacaccttggtcagattccgttgagtcccaagaataaatattgttatctgtatccattgctaggaaatgacttctcccagagcttaccgcgacaaattgaatatcattaaatgatcctaaattttcatccctaccactatataatgggaaagaatttcttgcgaacattctcctgatatgattatttcctggtacagccttgttagcacttcgttccagcatttctatctggctgtaaatattctcatgcggccccattgaaggcattgtagttctagggacaccactatggctccctccgggagaggctgcaggcgcacctccgctatctatggtaatatgctgagctgtagttgcatttcctggttcataagcagtagatggatggctaccgctcattctccttccagaaaatgtacccgtggtattgacagtactcccattactgcggctagtgatccgcggatacgatctttccatattgtgaatcatttctctgaagggattataatcatgctgtgaaccactgggacctggtccttttaaccctccagaaaaagtggatccgctgctgtaaaggttacctgactcagtcaatatttggaaagaaaaaccaccactagatacttgagctatgatttcgtctccatccttcttgatggcgcttaacgggtcctctgaaggagtgaagttactagttctagatgttgtcctactgttaaaccaaggaacttcagtgggggtattgacaccatatttgaaccgcggacttggcccgtttagtgaagtggcgacaagttcattattggaactcgcggtatagcccaaccttccatgctttaaataaccccaactataaaactttgcatcatatgcccgtaattggtatacttcctgccatgacaaggtggggaatgcttctcttaaaatcgtctctgtgcaggtcttaaattccgccgaatttcgaccctggaaaggctcgtcatttgtctttaatgtcccaaatgccttatgaaatagttcatgccacaaaattttagagtggtcaaaatctagtaatgtattataatacttatttgtctgcgagaggttcttaatatcatcactgcttaaaaatggtagcgtagcttgaacgatatctggggacaatcctgcgtcaggctccttttctctgctctcaacttcactcatgatgtgcttttccatttataattgagagtatatcctttggacaataaaactatactccaaaaaaggggttggagcttttatacgcctttatccattaatcatccgtttgctcaataaaagggtctcggcgaggcgcccggaagaatcatctagcaataccttcaaaataatacggacattaaatacaaattaactaattatcattaggtagaggcctacatatgcaaattgggtatatattaagcactttaaaatcaattgtttgtagttgtttataacctattgaatactttagacaaaatctcagtcaaattagaccaatttttgattctgagattttcgttggctaaatggccattgtcagtggattggccacatggtatttgaacagctggcgcgtcgaatattctttccaacattctcaaacatgaaatagaacctccttctcttactagcaatggttctacgtcccatgcagtagtaatttcgtcctttaatatttggtatgcatgatttgttgggtcacccaaccaaccttctgcttcgtttaaaactttaatttctagatgattttgagatttcaattgcttgaaactttcttctaaatacgctttgagatctctcttgacttgttctacactttgctcaggtactaacctgatggagatacccatggtgacactttttggaataactgttatgttaccaggaccgctaaacttgactgttgtcatagacaaggaaggcttagtccagttggtaattaaatcttgaacagtagtattttcgtcgatatttgcaagctcggtaattttctgaaacctttgatattcttcttcagtcagatctttcaatggtgaataaaaatttggaatcataatttcattttgttcgttttgtagtttggacacgattttcactaaattaaccataggttcatcataaacaccaccgttaagaccagaatgtccgtcaggcttatcgctccagacttttatttgggcattaataacacctctcaatccataattcaagcatggatgttcttgatcaacccaagtagaattacttaataaaatccagtcaatatcttttccaataatatcatggtacttttcacaaacttgcttcaaactagcagatccgatttcttcacttccttccaccaaaaatacgacatcgttcaccaattctccctgttgaaacaaatacgccacactatgaatagcgctcaccaatggccctttattatctgatactcctcgaccttttaagtatccgttttcacaagttaaagtaaatgggtcggtattccagttgaaagtatttccagacgatataacgtcataatgcccataccatagaatacgctttttcttggcacccttcacctgtgaaactttcccattcccttgaaaatatgcgaatacaacaggattaccaccatcaggcaatggaaataattgggagtttgtagctccaaacttcaagaataattgttgcaggtagattgcacaacgccttaatgacaaagtattagtagtgtctttgctttgagacactgtctggaaagaaataagttctctcagtgtgtttaacatctcctcgttatttagagaggcagattgataggcggcccataaattggtggtttgtaatgtagatgatgcattgatgggtgagttgcttgacagaggcaccgcagataataatgaggttatatcccagagagtcaatgacccatcgctaccacccgttaataaactaacagatccagcatttgatttactgaaaatctctgagcttaatatttttccttgttgagggttccaatggttaacttggttctggtaaaaatgcgtgatgcctgattcatcaatggcaaatacatggtccatataaactgatattgaaatgacgtccgattcatgctttgttttcagagttgagattatttgctgagtatttaagtcccagatttttataatcccgtcagtcaacccgcaatataaaaatgggaactcaatagtttgggatatgacgctatcttcattgtcgattttatcgtttatcaaggagattttaacagtgttttgccctttatctttagagaactcccaaagcttgcttattccatcaccagcggatgaaattatgtgctctgcaccagaagttcgtgagcttttttccaataactgattaaacctgggacacaatttattaatagaataaataaacccataatgtgcatatttaataatgttttcggagggaacctctatgatggcagcgccacagttttcttgtagagaggtcaatgaagtttgagataatgaatttgaactatatccagtcggacctaacgaatcaaagaacttatcatatcttctatgcggtaatttattgatattttctactccatcagaggattttttttcaatcttctgaatcaagttctcaacatatagtaagcttgcattttgacagccaaagacaatagtttccaacgaatccaaatatgccaatgagaaaatatcaccaatatcggtcactgagtaaacagtggctatttcagtaacaggtagaaagtcatctctaatggtcttttcgccaatggaccaaattctcaccaaagaatctgcgccgcctgaaaataaaaagttttcatcttctgatcctgtcaagcacaaaaccgaagatctggtatgcgtttcctcttgtgattcgcctagtctaatcgtatgtattagattatatgtgggaagatcaaaaaccaatatcttggagtcttggctaccagcaaacaacaatcttttttttggaaatgcaacaatggataagatggaaaaagcgtgattccacctatgaattagttcagagtgcaatgcgacacccctgctatcgtacatgatttcacaattacttctgccctcgtttttcacttttccttacagggttgttcggtttctcgaaatagtttttcacttaaataattcagttacacacattttattgatattggtgccacagcttttcgcggcgcacaatgcgattatcactcaagtttatggtaaagtcggtattccctctcatgagaaaaaaaaaaaaagataccatcttcattgaacttctaattgcagcagtaattgtgagcaatgctcaagagcttccttaccatataacaaaacatcgaaatcagaggatcattctagatcaaagtgaaatgcccttaactatgaaaaggaatacgaaaatagctgtgaagtgttattataattattaacaaggttagtaatctttaaacagagcctaatacttgcgggaaggactttcaatgttgcttcactgcagcttgttggcggctatttgatgatgattttcttgagatacataattattattatcacgtttcacggattatttttgaaaagctagaattaatacaaaagataggactattgaagtagtatacaccaatttttgcttaaaaaaactacgggaatcaaagattaccttgaaagtgaggacagcaaataactaaaatgaaaggctcacccatttctcaatttagtaagacctctattaatgctcttaccaggccttggaagaaatacagagatggtgaattattttatgggttatcaaaagttgggaataaaagagtgccgttgaccacgaagcaaggtaacaagacgatgtacaaagggacaagagcttcagggattggtagacatacaaaattcggtggttatgtgataaactggaagaaagtcagaacctatgttaccccagatatggttaatttcgaattaaagccctacgttaacgcaaatgtaccacctctaaaacacgaatttaaaggatttagcggcggcccattagatcctcgtttacagttattaaagataaaagaatacatagtaaacgggagggtacaaagcgaaggggccaccgacacttcatgttataaggagcgtggataagttatttataatctttcttcaatatgcgtgtaaatactagttttcgactttataggtagataaaaaataaaacttaagattgtaaaacaaaatcaaataaaacatggcttagacattgcaccatatgtcatctttctttgagttaaatatagatacatataaatctaaaagaagagcaaaaagttcgtacgtatataaatgcgcgtagcagagagaatttgatcttcttttttgttttccttcttttttttcttttctttgtttacatagcacctggaacacccaagacttgattcaaagcactttgaccgccactttgttggtattcaatggtaatgacttctagcaaagaaaacccaccagcaatgccaacaactataccagcagctttacctttcaaacccaaagattcaccgataacggtgatcaaacttaagacggatgcacccgtaacagctgcgattggaatgactttgttcaattctttagcgacattctgttctctgcgtcccatcaaagtgataccttggtctttgaattccaaggctacatcacgagcagaggaacctgaaatagcctgccacttatcagcaaaccaaataccagtaaccaatataaaggcggaataggtgatgaaggttaaaggttgttgagtgacacctttgaagaaagatgttggtggagccaaaagagataatgggaaggttgggactgctaaaagattattagcattctcatagtggcccattattttgcagatgatgtgagttggttcattcttggcaaccaattgaattaaaacgaaagcaaaaatgtggatgtagaacaagatggtgtaagaaaacaaaacagataaacagccagtgtatagtagcttaattgggtaaacattgtttgtaccacgggctcttgttgatctgattggcaattctacacggacactttgcaaatagcacacaataatggcaattgccaaaactataatagtagttgtcaagtttggtagatagtctctgttgaatgcagagatgatgccgccaataaatgtcttgtgcttagatcttaaaccttgaatcaaattgattagggcaccttgggcttcggtttggtcgtcctcgccaactttaatttgagaaacaccaaaagtatcagccaccaagttagtggcgattaccacagtgttgattatcatagctccagaagaaaatccaaatcctttatcgatgacttcagctaacaaagtggtgaatatgccagcaccgaccaattgaaagttgatcaacccgatctgtaccacagataaatcatcaccaaaataacctgcaaatatgaaaatgttggtcaaaatcacatactgaacaatggcaaaaacttttgttaagctttgaaataattctctatcactttggatcttgaaattaactttaattactttcaaaccggctaataattgtaagattaacccactagaaatgttgggaaaaaggccaaattctagcaaggttcttggttcacacccaaatacacctcttagaaaataaatggggtcattaacattaggtgtggtagctttgggcaaaccaacaagtgggaattgtgcaaaaaggtaaattaaccctgcaaaaatagtatagacaatcttgtcatcaaatggtaatttttcaaaaggtaactcaacttccggtaaaatcggtaggataggcttaacgatatcaattagacgaaaaccagacatactaaaacaatggagagtggcgggggcaaatgtgctaaaaaatgcgtacgagtaatggattcaattcaataaagctatgaaaaaccacccaacccaagcaaagaaaaaaaaaagagcaagcttttctgcagtgtattcgatcttacttttattaacttttactaattcaatgaaggaccaaatgacatctatcaagactgtggtagctagcgaacaaaggataactattttgtcggtgtaaaacaaaccctgcttccgctttgctctctacccgacattttttttttcactttttcagctcttttctttgccacgaaagcgtgtaaagtgatacagatcctaccgtgtctaatgatatcgttagcgcccctctacatggttgcattaagtacagacagaggaatgattaaacctaagacgaggatagtccttatgcattatgaaaagcaattcagggcagttgaagtcacatatatggctgcaaatcgaatataacttgtaatgtagttcaaagtggccggtagcaataaaaagaaaggtatctcaacaactttatgtttcacgttatgaaagaatatcgttaacagtctcaacagtgtctgttcttataatttggcatgagtgtatgatggttgttctctgttgtttcggtactatcaacggttattatcattggacgcaaaaatatcgttggcggctaaatacgggggtggcaaagagtttgcgcccgcgttcagtggatacaaacagtataagtaggacaggcgacatctttagtaaatagtacaggaaaaggaggacttatcagggtatcacacaaacaatggtacagaacaatgaatcggtttttttcgttgaatgcgactcttataaggagagcccttccacttcaccaatacgcttggacgacctggatggaaatgacgctgtgtcggatcagggtttagctttcgacggggacgtaggaattacatcacaagctcgagtaagaaatcctcgagctcaaatcttcgaggatagtaatactgacgtagtattgcatttggatgatcttgatatggtcccactaaatacgaagttcgatatgcagatggagatgggttcacccatggcgatgccggcagaaacgccacctcctgtcgaacctttaaaaacaaaagatctagcatattcatccttggctcaccttcctagctatttctttgagcaaacacatttccgcatagaccgcaaatgcctgttggaaatgtctaagttaaggcgaaattatctaactataagtaaacaagatgctttgtcatgtccgcagcttcattcaagagtggctgggggttatcttaaacctgtaaaagaaaaattatttggaatacgtcactttcttgatctagaggaaagtaatactgtaaacctcctccaggatggtaattatatgacggaattgttcaacagtcagattaatatccccacttttaaagaatttagggaagattttgaatggtgcttgaaaattataagagatagaagcctatcaaggtttagcgaaaaaagattacaatatcttgtaaataagtttccagtttttcaacacctacattccaaggaagaaatgagacagagcaaaaaggtgccacacaaggatttttacaactgtagaaagattgatctgaatcttctgttaagcggctgtttctcacagtggcaattgactgagtttatttggaccaagttgagaaaagaaccggacagggttatccatcaagcttttaatggtagtcatataaccttgagccaattattcaaagtgaatttcgaggagaccggtcagttcttcaatgggttgaaaattattgacgattcatttttggagtggtataaagttatttatctcgcaaaatatcatttggttaacgatgaaatggaaatacacacaggctcacacggtaagcagcttcgatactatttgattgcgaaaacatttttggagtttgataactatattaatggtgaatacttagcggaactactgaaaacgtttttaataaaaccgcaagaggagtcgaaatatcagttatgtcaactctccgtggacttccaattttatctgcattacgataattccgatgtggacaattggtggatggtctttgccaattggctgaaccactataatatattttctaacaatattcgctggaatattcgcatttctagaatttatccagaactgtatcatactggcaaggtgaagaattttcaggagtatttaaatctaatcttcaaaccacttttcaatgccgaaaattatctacacaagtcattaggacctattcttttgaaatttctttctcaagtatcttcgattgatctatgtattcaagatacggacaactatatttggaaaaacttcacagcagttagttgcttgccaaaagattggacatctggcggtgataatccaaccatttcacaatatatgtattacgtctacgtcaacctaacaaaattgaaccatatccgccaagcccttcatcaaaataccttcactttgagaagttcatgttctcccacctcaatgaatcgaacttcacagtttagtaatacactgaacttcacagaacatacggaagctattttaaacaatttcttgctcgcctgtggagggtttctaaatgcagaaaatctctggaatgcaccaccatcactggtgtatcttttctatctaagtcaaattcccatggttgtggcgcctttgaattccatagtagattcaaagcctacaatgctgcaagaacaagccccgacggggcttgtcctagagccctcaaagccttataagaagaaccctttcatgaagttttttgaaatggggttcaagatatcgctgagctcagaatctatcctctacaacaattcgtatacgaaagaacccattatagaagagtatagtgtagcggctagtatataccgtttacattcagcagatttatgcgaacttctaagaaacagtgtcataaccagtggattttcaagtaccctaaagaacaaatggctcggcgtttccttagccagccatgactacttcgtggaaaacactgggtttgtagacaagtggtatgattgtaaaccaaatacaagtttagagcataacgttccgatcatcagacgtcaatatcgcagtagcactctcgcaggggagtggcgactcataattgcgtgaattcgctcatgtttcttcgaggggcgcatattgtgacgctaatattatgtaccgcccttccccacacacacaaaaaaaaaaggttaaggataaagataagtaaactaatggaatatataaacaaataagtaagtagatactgtaaatagaacacacgttttttaatttatttttttttttacatatcttaatttaatataaatcaaaaagcccaagcctcaaacaagagtcttatcactccatttataacataacaattcgaaatctctaagctcgcttatagttgacaatgaccatattttctaggttctcatattttgatagtctattctcctttaaaaagcaagagccttcccccattgaaataatctattgcaatgaaaacaatggtttcataaacataaaatccttagaaagccccactgacgatagcatggaggcggacatttcacatagagaaatggctacaatcctgactagaaacagaaacaatttgggtaaggttgccattgataagaaaggcgttaataatcattgcatagatttgaatgagctgaaaaagggccttgtcgccaatgaacacaaattggataacgataactcaacacggcaccagaacacatattcaccagaggattccgtggaatttgataggttcgatgataaacaaagcagaatactaaagtgtagcactagaaggagctacttgagatacaagaaataagacaattgagctgcttcattatatatcttgatataatcacctttcttatcgtcagaaagagtgttctctatgtttttctgcttccataaatatatagttcaaaaagtaatatcatatactattaataataaaagttatactgaatatattgattagttctattaattactattgacacactttgaattcccttaaattaaccctcaggaagaaggggtccttaggaaaatttttcttttttcaatataaaagcgaggaacaatggatgggaacaaaaccatgttcagcctttcaacaattggtagaagaagccaaaaaaaaaaaaaaaacagaaacgccaaccatgcacttttctttgaagcaattggctgtcgctgcgttttacgctaccaatttaggctctgcctatgtcattcctcaattcttccaggaagcctttcaacaagaagagccaattgagaattatcttccgcaattaaacgacgatgatagctctgccgttgctgccaacattccgaagccacatattccttacttcatgaaaccacatgtagaaagtgaaaaattgcaagataaaatcaaagttgacgatttgaatgctactgcttgggacctctaccgtttagctaactattctactcctgactacggtcaccctacccgtgtgatcgggtccaagggtcataacaagactatggaatacatattgaatgttttcgatgacatgcaggactactatgatgtttctttgcaagagttcgaagctttatccggtaagatcatctctttcaacctctctgacgccgaaaccggtaaaagctttgctaacactacagctttcgcactttctccacctgtggacgggttcgtaggtaagctagtcgaaattcctaacttgggatgtgaagagaaggattacgcctctgtagtcccaccaagacacaacgaaaagcaaattgcccttatcgaaagaggtaagtgtccttttggcgataagagtaatttggccggtaagttcggtttcaccgctgtggtcatttacgacaacgaacctaaatctaaagaaggactacacggtacattaggcgaacctaccaagcacactgtcgccaccgtcggtgttccatataaagttggtaaaaaattgattgccaatattgcattgaacatcgattattcattatattttgccatggactcttatgtagaatttatcaagacccagaacatcattgccgacacaaaacacggtgatcctgataatattgttgcccttggtgctcattcagactctgttgaggagggcccaggtatcaacgacgatggttccggtactatttccctattgaacgtcgctaagcaattgacccatttcaagatcaataacaaggtccgttttgcatggtgggctgctgaagaagaaggtttgctaggctctaacttctacgcttataacttgaccaaagaagaaaactccaagatcagagtatttatggactatgacatgatggcttctccaaactatgaatacgaaatttatgatgcgaacaacaaggagaaccctaaggggtctgaagagttgaaaaacctgtacgtagactactacaaggctcatcacttgaactacactttggtcccatttgacggtagatccgattatgtcgggtttatcaacaacggaattccagccggtggtattgccactggtgccgaaaagaataacgtcaacaacggaaaggtcttagacagatgctaccatcaattatgtgatgatgtctctaacttatcctgggacgcattcattaccaacaccaagttgattgctcactctgtggccacctatgctgactctttcgagggtttcccaaaaagagaaacccaaaagcacaaagaggtggacatattgaatgctcaacaaccacaatttaagtacagggccgacttcttgattatttaagtgtactgttcacatcaagtatttctgtataattatctaaaagaaaataaaaaccctcttttttttaactgcacgtgcatcaaggggatcacagcctccttatcaaagtgaaaaaaaggtagaaaaaaaaactgaaattgtgatataaaagtttaaacaggaaattattgtaaattgaacaatatgtgtgaagcccgtttttggtttgttattcccaactaaccataccctcatagattactctgcatttctactatatggttgaaacatttagttttgctcatttggcttatttggtctttgagtccgttttacaggtagtcattatcgcactcgctggtttttggagcgctagttctggtctgctgcccaaacaaagtcaaaaaatcatttctctgttgaacgtggacctttttacaccatgtcttatttttagtaagttggccaaatccctgtccatggccaaaatctttgaaatagccatcattcctattttttttggtttgactactggtatttcatttatttccggaaagataatgagccgtatcctagacttggataaagatgaaactaattttgtggtggcaaactctgtctttggtaacagtaactctctacctgtgtccttgacattatctttggcttacactctgcccaacttaacttgggaccaaattcctaatgataacagagataacgttgcatcaaggggtattttatacttgctgatctttcaacaaatcggacaaatgctgaggtggagctggggttacaataagctaatgaagtggtctggagagaacactcagcatatgccaccttctcaagtgcaatctttgttggaaaggacgcccaacattgataacgaggaacttgtcaatgaggaacaagaggaacaagaattgcttgaagaagaaaataacagaatgaactcatcttttttgagttcgagttccatcggtgataagatttggcaaaaatcatgcactgtatttgagagaatcagagcgaaccttaatcctccgttatattccatgatttttgctgttgttgtggcagcaattggtccgttgcagagagagctatttatggaagatgggtttatcaataacacatttgccgaggctgttacgcagctgggttcagtttctatcccactgatcctggttgtcctcggttctaacttatatccttctgcggaagtcttccctaagacggttcaccatagcaagttattgatcggctccatcatcggaagaatgattttaccttcttgcttccttttgcctattattgctattgctgttaagtacataaacgtgagtattttggacgatccaattttccttgttgtcggttttcttttgactgtttcccctcctgccattcaattaactcaaatcactcaactgaatgaatttttcgaggcagaaatggccgatattctattttgggggtacgctgtcttaagtttgcctgtaagtattattgttgtctcaggtgcaatttacgttttacagtgggctaacccaacttaatacaacttttcattcctttgtatagagtcttcatgaatgaaagtcttattcatttttttttttttttagcatagttttatattccttttttattccaagacttatattctcattatattctatttagtttcgcatggaatttcaagtacacatataactacagccttacttgaaaattgcctgtctgggtcttatactttgcacccttgtacagctttgtatttttgccaattgttaatccagatacaatatcgatggcttctacatagattccactggccgattgtcctatgtaagaatattctaaggagactgtttgtaaatcaactttttttgtaaaatttggcccagtattttcatactcaatacagccacgtagtacaggtaccgttccagtggcagttgatttatcaaaaatccattgtccttgacccatgataatgctattttcaaaacggccatgagtattgcgcaatatttttatcttatatgctatttcatttggatcagcattctcaacattgaactgtaaatctatttttaggtcatcaacttgtgaaacttttttgaaattttcaatatttaaggataactcaaattcatcagaatctttacccaatccattttggaagtgtaaagacatcaagccaatagaattcatccttactccggattgctttacttgagaacttaaatcgacggaatactccagcaatctgaacttcccatctggtggtataaacgttatattagagggagaaaacacaccatcattgatttcaacacagtcatgcaaactgggtatacctatatcatttcccatagtgtttaattttactgcaactagaggattatcattcaaataagatctcacgtccactattccatggatacttccagtgagcaaccttagatgtgattttttcttttcaaatacaacatggaatgtttctaacaaatccacataaagctcattattctcatgtttgctagcccttgaagttctccagggaacaatctcttcattttcgattagtgaattactaccacgagaaatctgattttgttgtagctgctgttgcctttgttgtgggagttgcacagcctgctgtaaattatgggctgtagaacttatgaacttcgataaatccgatctttcaggaacagcttctttaattttattaacatagagcatatcactcacatttggttcacccgcttcgacgcaacagttaaaaatcaaactgattctatcataattattaacaattttcttgatacttaatttatccttgtcaaaatattctaacaggatacgatctatagtctctaaaaaggtaaaacaatcaagcgggccttttgacttcgaagtggaggctaagcaccaataattgagcttatttataactgagaaatacttatagacctctaaatctcttccaaccattgaatggtctaaataatcatcactactgctatcttcgagcaattgaggacatgtggtacgaacgcgggtccacaggtgcttgaaggagggagctgttgcacctaaaagatactggaaaataagtttgttctttgtatcagtgatatagaatgacaaatacatctattttggttgggttggtaaggtttacagcctctgttgttgcccaagtcctgttatcgccaactttaaataaatctcttcttgttctttgaccaaaaatttcatttttcgtcgcatttaaaagaaactgaaatttcaaacataaacaccaaaacaaagcatcatcaagggaacatatagtaaagaactacacaaaagcaacaatgaataatcagccgcagggtaccaacagcgttccaaatagtattggaaatatatttagcaacattggaactccatcttttaacatggcgcaaattccgcaacagctgtatcagagcctcacaccacaacaattgcagatgattcagcaacgacaccaacagttactgaggagtcgtctacaacaacaacaacaacaacaacaacaaacttcaccgccaccgcaaacgcatcaatctccaccccctcctccgcaacaatctcaacccattgctaatcaatcagcgacttctacccctcctcctcctccagcaccacacaacttacatccccaaattggtcaagtgcccttagctccagcgcctattaatttgcctccacaaattgctcagttacctttggctacacagcaacaagttttgaacaagttgaggcagcaggccatagcaaaaaataatccacaggttgtgaatgcaattactgttgcacaacaacaagtgcaacgccaaattgagcagcaaaagggacagcaaacggcacaaactcagctagaacagcagaggcaattgctggttcagcagcaacagcagcagcaacttagaaaccaaatacagcgacaacagcaacaacagtttaggcatcatgtgcaaatacaacagcagcaacaaaagcaacaacaacagcagcagcagcatcagcaacaacaacaacaacaacagcaacagcagcaacagcaacagcaacagcagcagcaacaacaacagcaacaacaacaacaacagcagcagcagcagcagcagcagcaaggacaaataccgcaatctcagcaagttcctcaagttagatccatgagtggacaacctcccaccaatgttcagcccactattggccaacttcctcaacttccaaaattaaacttacccaagtaccaaactattcaatacgatccaccagaaaccaagctaccatatccaacctattggtcagacaaaaaagcagatacggatactttgttgtacgaacaaattatccagcgtgataaaattaacaaatattcgctaataagagaaaccaatggttacgatccgtttagcatttatggatttagtaataaagagtatattagtagactgtggcatacactgaagtattatcaagatttgaagaacactagaatgaaatctatcacaagcacttctcagaagattccttcggcaagtatttggggaaatggttactcagggtatggtaatgggattacgaatacaactaccagagttattccacaagtagaagttggaaataggaagcattacctagaggataaattaaaagtctataaacaggccatgaatgagacatcggaacagttagttcccataagattggagttcgatcaagatcgtgacagattcttcctcagggacactttgttatggaacaaaaatgacaagcttattaaaattgaagactttgtggacgacatgttgcgagattaccgatttgaggacgctacgagagagcaacacattgatactatttgtcaatctatacaagagcagattcaggagtttcaaggaaatccatatatagagttgaatcaggaccgtctaggcggtgatgacttgagaattagaatcaagctggatattgtcgtgggacaaaaccagttaatcgatcaatttgagtgggagatctctaatagtgataactgtccagaagagtttgcagagtccatgtgtcaagaattagaactaccaggtgagtttgtgactgccattgctcactccataagagagcaagttcatatgtatcataaatcactggcactgttaggttacaattttgatggatcagcgatagaagatgatgacattagaagcagaatgctcccaacgattactcttgatgatgtttataggcctgcagcggaaagcaaaatttttactccaaacctattacagatttcagctgcagagttagagagattggataaagataaggacagagacacaagaaggaaaagaagacaaggtagatctaatagacgtggtatgctcgcattgtccggcacatctgcaagtaatacatctatgaacggcgttcacaacacagtagcagcaggaaatgcttcatcgttgccaccaggagagattttactgccagatattgcagatattccaagaactttcaggactccagtacctagcactttaatgcctggtggtgttgacgtaggcccttctgtggaatcgtacgaattgagaaacacaaccacttataaaagcaggccagatagacctaagccagtttcacctccttgttatattattgaccatattccgggtcattcgctactactttctattaaactgcctgggaaagttaatacaaaagaagagttcgcagcagcgcccaatgacacaagtagtggcaccaatgcaatgcttccgagtccagaatcgctgaaaactaagctgaatagtaacattcgcgctggtgtgacgataccttcaatcccaaacccgattgccaatcacactgttactaattcacccaatcccacactgcagccagtaatcccaggtggggcagctagtaaatcggtacctacacctagtcttcctatagcacctccagtagcaccacatgatagcgaagcgacattgttgactaatagcaataatggtagcagtaacaataacacacagaatacatagaaaatatatacacatatataaaatataccggagatgtaaataaccgtggaagaatttgtattatcatcgtgttatacgatgcggagtccctttgcgcctactttttttagaagaatagtacataacctttataaaaatcttccaatttagatacataaaaagagcatgagaataacaagaacacgtagtctaggaaactaagcgctatgccagagcaagaactacttatagggcaagaaatgaatacacttcatgcaggttcatctactgatggcataaatgtcggaaacgcaggacgaactagagacacacaaactggcgtagaaggggaaacggaaatagggtctgacgaggaagatagcatagaggacgagggaagcagcagtggaggaaatagtacgacagaaagactagtaccacaccagctgagggaacaagcagccagacatataggaaaaataggaagacattttaatattcttgatagactttttaagaaacgtacacaacagtcttcggatatacaacaaggtgccatgtttgatggtgtctttagcaatttaagcgcaaaaccagataccacagagactgaaggtaataacgaacaagacataccacctacatacgacgaagctgctgctgatatggccccctcgtattatggaatggatttgaacaattcagatatctactacgacgaaatatgcattgaggggcttcctgtaggaaatatagcaaatttattatggaatatcatcgtaagcacgagttttcagttcattggatttttaataacctacattttacacacatctcacgcagcaaagcaaggttcaaggtttggattagggttaacgttcattggatatggttattcaatgattcccaatgatgttacttcaaaagtcggcaaaaataaaagcttaaatagaatggaattagaggatccaaatgaattcgatgatgttcgtctaaattcacaatcaacgacacaagataaatttgaatcacatttgaatcacggtctggatgaagaaaaacaaaacataccatggttggctgtttttgtggcatttcttgggctatttatcaccctgaagagtatatacgactacattcaagtcaaaaaattggaaaagaaatacctcaaccaaagtcaaaatcaagcataagccatcttcttcattatgataaaaagagatatataacttttttaagtgatcggctggtaaatagacttataacgagtagaaaacattagatgatatattgtacacaataatacatttcaggctagcataactaagaccttttcatagatagtgaaaacaataccaccactcaagaccaatctcccaagtctaggcgtagcacctttccaaaacgtctttaacccttcttctttgaaaatggttgcaaaacaattcattgtagaggagtatttggtggaatccaaactttgcattcttgttttcacagtatcaaggggcatggtggaatagaccgtcacaataccactaaatgcacccactaagaaggttaacccggatgataaaggtttgtcttttggcgaatccgtataatcttggatcaaggtcttaatcttattgtaacaacccaatctaacggcttggtttgcggcctgtctcatggaaactggcaaaacaccacgataaagaccagaaaatcctttatcacggactaatgatgaatagtttcgtactacaccgcgcccattattatggtattttggtgtagcagattgtttatcatcgatcaaagcagttttgattgcttcaaaaggagtcactgcggcaacactttctaatagtcccgcacctaacccagctatcacccctcttgtaccacttagttctccagtttcactatctcttagcatgtctttaatggtatcaaagccaagaaatctaatacccgccttagcggtgtttccaataataaatgcgggacatccgacataaatggaaccaatgccctgagtttttgcagttttatatatcaataccagaggatttcttgatgccttggaggccttatcaatcagctgcagccttgttttggcaaactcaaaaggatatgttatacatgcttcagcagcaccggctagggaccctgccagaaacgagtgcaatggatctacgtcacttttggtagctttactggacatcggtaaaatgctaatttataattcaagctctactttggagttctttcattgtgacatcaaaatgtttttaattttacgttggcttcgacattttacgttttatatatcacgctaaagtgagactaaatttcattgttcttcttttttttttttttcacttctaataattgaaaattccgcaggaattcttccatattcttgactcttcagtaagactaacttaatggaaatagagaaaatagtacatatttgaaaaaaaaaaaagaggtgttgaaatgatttgagaatattaaatagcttacaagcgttagccgagttcccagacagcagagtttctaccctgtgctctttgttggcggctttattgatgaggaatataaaaatgtaattaggcaaacctacgcgcgaaaatataagaagcaaagatataaagtgtagtatatttgaatatttacatgaacgaaacggcgacgtataatggtaatcggctgggaacttcattaaaaagtcaagatgtaagttacctcttagtaagaagagttattgcagcaagcttagtatcaatagggagactctgtcatgtaaaaaaataaatgaacacaatcataacctcttcgactgggctattcgttgtatagtatatgtggtggagtgtaatgaatgaagttctcagaagcttgaaagcatatcaaaatcacgtattgactatgacagattcttgtttcttgctccattactccattcgagtttttcacaacttttgtcgttcgtctataacatctcttttttttcccactcttctaaaatattggcatagctgacatgtttggaaccgaataagcaattacaatacgacagtaaaataaaagcatgttattgctgcttgtagagaattcctgcatatgtaactttctcattccgacgggataagttcataaactaatcagcgatgagttgcggaaaattcgtcaatagaatattttccagtcagtggtggtcccagtggcctgcaacctaatggctatagttctggataataaattgggcaaaggtcagtataaagaatgaatgtatcaggccgtaattgaagctttcaagtccaggtgaaaggccaaatcgacaattagcgaaaacaggatttttttaccaacttgaaatagtgactgctgtctttttgcctgattaagtggttatatatttcaactaatatcacaacaaaaggcctctcaaaatttgtggcgaagtgtacatcctgggtgctcaggtaagcgtcgtcttcgtattttttttttttcaacagtagtttggaaataatgctcttcgaggaatgcgagcggaaatgttatccactgtataagtcgatattttaagggacgctaaatatatcatcatagctcgtctattggtggcttctccaattgcactttcaatgcattatggtaaagtgtggtgataaggcatagtgatgtttacagaggtctgttggtttctctgggctcgctcatcatccgaccagtaaccttgtggggtttcacatattgttctatgcattattatcacggatttgtgcctgcaaatgctgtttctttggcttttctttctaaaaaaattatgatatatatattgttcctccttgtttaacaggctttacggtattgtggatcctagtaataggcgtacttttcttcatttacatatttgaacaatatatgtctcacaagtagttgaccgaatagcgttacgtaagggtcaaaaaccttttcagaattgtatatatgacatttttagaacatgatataataaacagaatataaaagaaaatagagacgacgtaccatggcatgaagaattgtactgatatcacattgtgttgagcactgatagattaatactatatttctgctaggtgcggggggtaacatgtcctaatgtgtggcaaccacattctaaggctcggtaagtgatgcgatatatgtgcatgtgtggctttcttcctaatttgctattagatgattgtgtgcaaatccacagaaatatacaatttcgagaatatatatactagttatcgttataagaacacacagtattggccaattcttgcctctgaatggtacaaaatgctttaaaatgtagtaaatgaaacattaattccaaatcagatttttttctgcaatgcttaaatctagtaaacacaagtactaccgaaaagcaaggatggaaactatggcagtattgaagagactgaaattccttctgtcgactacagtgaagacttagatgaggacttggacaaaggcgaagatatagcgctttcaagaatcccaaattgatggattattgaagctactcttttttctaatgtctttttgtccggttttgacggaaccgttacagcttcgacgtaccaaacgattggtaacgaatttaatcagatgagtatttcaaattggatcaccactgcgtatttaattacatcaacatcttttcaacctctttatgggtcattttctgatgcacttggtcgaagaaactgccttttctttgctaatggggcttttaccattggatgtctagcctgtggtttctcgaaaaacatctacatgcttagttttatgagagcattgacaggcataggaggtggtggcttgatcacactttctacaatcgtaaattcagacgttattccaagttcgaaaagaggaatttttcaagcgtttcagaatttacttttgggatttggtgccatatgtggagcgtctttcggtggcacaatagcgtcgagcattggttggaggtggtgttttctcatccaagtacccatatctgtgattagttccatattaatgaattattatgtacctaatcagaaagaatataatcgtcaaaattctagcatattccaaaatcccggaaaaatactcagggacatagatgttatgggctcaattcttattataactggtctcacactacagcttctttacctgagcctggggtgttctacttctaaattatcatggaccagcccttctgtgctactgctattagttgggagtgtaataatcctcttactgttcatattgcacgaaaggaaaacaagtgctagagcgattattcctatggagctggtcaattcctcctacagtgtcgttgtactttcgataagtatacttgttggttttgccagctacgcgtatctttttactttaccattattctttcagattgtacttggagattccactgcaaaagcaggattacgtcttacgattccttccctatttactccggtaggcagtctcataacaggattttccatgagcaagtacaactgtctaagattattactctacattggtatttctttgatgtttttgggtaactttttattcctgtttattgaaaaaacttctccgaactggttgattggtctatttttgatacctgcaaatctaggacaaggtatcacttttcctacgaccttgtttactttcatatttatgttctctaagagtgaccaagctactgcgacatcaactttatatttattccgtagtattggatctgtatggggtgttgcaatttcagctggcgtcattcaattatctttcgcaggtttattgcgtagtaatttgaaaggtctactggatgaaaacaagataaagaaacttattgttcagcttagtgcaaactcctcatatattggatctttacatggcgaagttaaaaacacagtcataaagagttttgatgaggcaacaaagagggctcatctaatgtctacattactctcttcattggccctgatactctgcatccttaaagacaatctggcgaaacctaaaacaagaagataaacaatatatacctatgcccttgaccgactcaattgatacattaacagtattgaaactagatattctacttgacactaaactttttttgtatttcgtggaattgcaacgtttctaattgaccgacagtgctgaactgtgagcgaatgcaactatctctatagtttttttatcctctgtaaactttaactaaatacatactactttcataatctgtgaataagatgtggctgtgataacctaaaatagtcacaaaccaatgaaaaaaggcttcagaaaacttgctgtaaagtccccccacttttttgtgttaccgccacctcgagtgcactttttttaataaagatctcgtgtaattgtccaaatctgactttttcttatagtctcgctggaaccacagtgcggctttgcaattttgcaaatcggaatttgagtcacagatcccagaaaaactccacaccttccccacgcagcaagcgataacgaacaagttgtcaaattagacccataataattttgaacacttctacctgttcatgtcttttctcgaacactgtcatttgaaattatgcactgtgaaaaaaagaaacaaagaccaaaagaataatataaatagtgaagtaaaatgtgttgtaatgcacatggatcttgtactgctcaaacttaatatttctattgtagaaaaattttcgatttaaaattgtgaaaccgattatataaaagtatattagctgacattaacgtctcaaaaccaggtcaatagctttaaaaataaaaataaatccctgcagaatactcggaaagaatatgtcacgtaagagctcgactgaatatgtgcataatcaggaggatgctgatatcgaagtatttgaatcagaataccgcacatatagggaatctgaggcggcagaaaacagagacggacttcacaatggtgatgaggaaaattggaaggttaatagtagtaagcagaaatttggggtaacgaaaaatgagctatcagatgtcctgtacgattccattccagcgtatgaagagagcacagtcactttgaaggagtactatgatcattctatcaaaaacaatctaactgcgaaatcggcaggaagttacctcgtatctctttttcctattataaaatggtttcctcattataactttacgtggggctatgctgatttagtggcaggaattacagttggctgcgtactcgtgccccaatctatgtcatacgcacaaatcgctagtttatctcctgaatatggtttgtattcctcctttattggtgcgtttatatattctttgtttgccacatcgaaagatgtttgtattggtccggtcgctgtaatgtcactacaaactgccaaagtcattgctgaagttctaaaaaaatatcccgaagaccagacagaagttacagctcctatcattgcaactaccctttgtttgctttgtgggattgtcgccactgggttgggtatactgcgtttaggctttttagtggaacttatttctctaaatgctgttgctggcttcatgaccggttccgcatttaacatcatctggggtcaaattccggctctcatgggatacaactcattagtgaataccagagaagcaacgtataaggttgtaattaacactctgaaacatttaccaaacacaaagttagacgccgtttttggcttgattccgttggtaatcctctatgtatggaaatggtggtgtggtacatttggtataactttggcagatagatattatcgaaatcaaccaaaggtagcaaatagactgaaatccttctatttctatgcacaagctatgagaaatgccgtcgtcatagtagtttttactgccatatcgtggagcataacaagaaacaaatcttcaaaagaccgtccaatcagtattctgggtacagttccctcgggcttaaatgaggtgggagttatgaaaatcccagacggtctgctatctaatatgagttcagaaatacctgcttcaattatcgttctggtgttagaacacatcgctatttcaaaatcctttggtagaattaacgactacaaggttgtccctgaccaagaacttattgcgattggtgtgacaaatttgatagggacattttttcactcatatccagcaactgggtcattttccagatctgctttgaaagcaaaatgtaacgtgcgcactccgttttctggggtattcactggcggttgcgttctattagcactttattgtttaactgacgccttctttttcattcctaaagcgacactatcggcggttattattcatgctgtttctgatttgctgacttcttacaaaaccacctggaccttctggaagaccaacccgttagattgtatctcatttatcgttacagtgttcatcacagtattttcatccattgaaaatggtatatattttgcaatgtgttggtcatgtgcaatgttactattgaaacaggctttccctgctggtaaattccttggtcgtgttgaggtggcagaagtattgaacccaacagtacaagaggatattgatgctgtgatatcatctaatgaattacctaatgaactgaataaacaggttaagtctactgttgaggttttaccagccccagagtataagtttagcgtaaagtgggttccgttcgatcatggatactcaagagaattgaatatcaataccacagttcggcctcctccaccaggtgtcatagtctatcgtttgggtgatagctttacttacgtgaactgctcaaggcattatgacattatatttgatcgtattaaggaagaaacaaggcgaggccaacttataaccttaaggaaaaagtcagaccgtccatggaatgatcctggtgaatggaaaatgccagattctttgaaatcactatttaaatttaaacgtcattcagcaacaacgaatagtgacctaccgatatcgaatggaagcagtaacggagaaacatatgaaaagccgctactgaaagtcgtctgcctggatttttcccaagttgctcaagtggattcaaccgctgttcaaagcctggttgatctgagaaaagctgtgaataggtatgcggatagacaagtcgaattccattttgccggaattatatctccatggatcaaaagaagtcttttgagtgttaaattcggaactacaaatgaggaatatagtgacgactctattatcgctggccattctagttttcacgttgcaaaagttttgaaggatgatgtggattatactgatgaagacagccgtataagcacatcttacagtaactatgaaacattatgtgctgcaactgggacaaatttaccgttttttcatatcgatatacccgatttttctaaatgggacgtttagtgtagtagatagtaagtactttaattaccccccctgtttttagttatacatgaaaagataattgtgttattaatgtagattaccatcaaatagctggaatatttattattttgagtatgttgaatggcgaaagtaaaaataaattttataatttcctgaaagcattagtacacgaaaagggccgttttcagtagtttaaggcgctgaaaagacatggtctagaagttaacttgagcttgagcctattttctacaaatgtcctttgaaaatacaaaaataaaaataaaaatgcatttaagtattaagcttatgctagatagagcaacattttcctaattttttttgaatttatttcatggtttttaggcggaaagagtttggacggcttgtctctcctaatgtggaagaaattatgttttgttatgaatctgaaaagaaaaatactattttagcaatacaatgaatttaaaaagttaccctgtactttaatccttcaattaaaacacttcttaaaatagtatattttgaagatcatcgatatatatacagaggcagttttgcaaggcagataacgttattgagttgtatgtaggctgtgtgattttaatctcataaatcaataatggaataattttcttattgttaatatcgatttatattttccaacaatacaatgaagtaagtactatttctatttggaaggaattcattccccattttagctcctcgagcggatgaatccatcactgttttgaagaaaaccaacaaagtgtcaaatagttgtctttttgaaattggttctgaagagttttcggaaaatgatctgataacaggcctttctaaaaatataaggttgaacgaatgtatgggttaggtaatcaaaatttaggcgccaacaaggaatttttctttaaaatcgcatgaaaagcctacacttggcataaataaggtgcaattataaatataaaagcaagatattttcgagatgcttccaggatttatacaatgaaagagcccaaagctgctgataacgatgaagccggaaaaactcttctccggtttaggtaccagcgatggcgagtatggagtggtaaatagcgagaacatatcaatagatgctatgcaagataatagaggcgagtgtcatcgtagatccatagaaatgcatgctaatgacaatctgggattggtctcccagcgagactgtaccaatcggcccaaaattactcctcaggaatgtttgagtgagactgagcagatatgccatcatggcgagaataggactaaggctgggttagatgtagacgatgctgaaaccggtggtgatcacaccaatgaatcccgtgtagatgaatgttgtgctgagaaagtgaacgacactgagactggcttggatgtggacagctgttgcggcgatgctcaaacaggtggtgaccacaccaatgaatcctgtgttgatggatgctgcgttagagattcttcagtgatggtcgaggaagttacaggcagctgcgaagctgtatcttctaaagaacaattgctgaccagctttgaagttgttccaagcaaatctgaaggtctgcaatctattcatgatattagagagacaactcgctgcaataccaattccaaccaacacacagggaagggtaggctttgcatcgaatcaagtgactctacactcaagaaaagaagttgtaaagttagcagacagaaaattgaggtttccagtaagcctgagtgctgcaacatttcatgtgttgagcggattgcatctcgtagctgtgaaaagaggacttttaaaggtagcaccaatgttggaatttctgggagtagctctaccgacagtttaagcgagaagttcttcagcgaacagtactctagaatgtacaatcgttactcctcaattttgaaaaatttaggttgtatctgtaactatttgcgtactttgggaaaagaatcttgttgtctcccaaaggtgcgtttttgtagcggggagggtgcttctaaaaagacaaaatactcctaccgcaacagttctggatgtttaacaaagaaaaagacccatggagacaaagaaaggttgagcaatgacaatggccatgctgattttgtttgttctaaaagttgttgcactaaaatgaaggattgtgctgttacctcaactatttctggaacctcttcgagtgaaatttcaagaatcgtatcaatggaaccaattgaaaatcatcttaatcttgaggcaggatctaccggtaccgagcacattgttcttagtgtttcaggaatgtcctgtactggttgtgaatcaaaacttaagaaatcatttggcgcgctcaaatgtgttcacggtttgaagaccagtttaatattatcgcaagctgaatttaatctggatcttgctcagggatctgtcaaggatgttatcaagcacttgagcaaaactactgaattcaagtacgaacagatttcaaatcatggttcaactatagatgttgttgttccttatgcagcaaaagattttattaatgaggaatggccacaaggtgtcacagagctgaaaattgttgagagaaatatcattcgtatttactttgacccaaaggttataggtgccagagatcttgtcaatgaaggatggagcgtgcctgttagtattgctccattcagttgtcatccaaccattgaagtgggaaggaagcatttagttcgtgtaggctgcacgaccgctttatccataatattgacgatcccgattctcgtgatggcttgggctccacagcttcgtgaaaaaatttccactatctccgcgtcaatggtgctagcaactattattcaatttgttattgcaggaccgttttacttaaatgccttgaagagtttgatattttccaggctcattgaaatggatctactaatagttttaagcactagcgctgcctacatattttcgattgtatcatttggatatttcgttgttggacgcccgttatctacggagcagttttttgaaaccagctctttgcttgtaactctcatcatggttggtcgctttgtgagtgaactagctagacatagggctgtaaagtcaatatcagtacgttccttacaggcctcttctgctattctggtggataaaactggtaaagagacggaaattaatattagacttctccaatatggcgatatttttaaggttttacctgattcaagaatcccaactgatggaacagtcatttctgggtcttctgaagtcgacgaagcgttaatcacaggtgaatctatgccagtcccgaaaaagtgtcaatcaattgttgttgcaggatcggtgaatggcactggtactttgtttgtgaagctgagcaagcttccagggaacaatactattagtaccatagccacgatggttgatgaagcaaaattaactaagccaaagatccaaaatatcgctgataaaattgcaagttatttcgtgccaactatcattggaatcactgtcgtcaccttttgcgtttggatagcggttggaatccgtgtggaaaagcaatcccgctccgatgccgtaattcaggccattatatatgccattacggtacttatcgtttcgtgtccctgcgtgattggacttgccgttcctatcgtatttgttattgcaagtggcgtcgctgcgaaaagaggggtaatcttcaaatcagcagagagtatagaagttgctcacaacacttcgcatgttgtcttcgataaaacgggtaccctaactgaaggaaaacttactgtagtacatgaaactgttaggggtgatcgtcataattctcaatctttgttgcttggattaactgaaggaataaaacacccagtttccatggcaatagcatcctatctcaaagaaaaaggtgtttctgctcaaaatgtttctaatacaaaagctgtgactggtaagcgggtagaaggaacatcatactctggtttgaagttacaaggagggaactgtcgttggcttggtcataacaatgatcctgacgttcgaaaagcccttgaacaaggatattctgtattctgttttagtgttaatggttcagtcactgcagtttatgcattagaggactctttacgggcagatgctgtctccactattaacttgttacgccaaagagggatttcactacacattttatcaggggatgacgatggagccgttcgttctatggcagcccgtcttggaattgaaagctccaatattcgttctcacgcaacgcctgcagaaaagagtgaatatattaaggatattgtcgaaggaagaaattgcgatagttcttcgcagtcaaaaagaccggttgttgttttttgcggtgacggaacaaacgacgcaattggtttgactcaagcaacgattggagttcatatcaatgagggaagtgaggttgccaagctagctgctgatgtagttatgttaaagccaaagctcaacaatattttgactatgataactgtaagtcaaaaggccatgtttagggtcaaattgaatttcttatggagttttacttacaacttatttgctatccttttggcggctggtgcctttgttgactttcatattccaccagagtatgcgggtttaggggaactagttagtatcctccctgtaatttttgtagctatacttctgcgttatgcaaagatttagtccaggtactgctgctatttgattgtagattttcttttttcttttcttttttttttttgacgactctgtaatactctatttattatttagtttagttttctatttaatatgatggaattcataaaaaaaaaaaatacacatagccatgccaggtaattgcagatcaactgataaattagaaaaaaattaatgcatctttaaggttttaaattaaaaatgttttaactttaaagtcactgagcaataaaagttctacctaatgttgtaaaactgtattcataaccgaaacacattatgattatgtcatttggtattccacaccaaagcgaggagcattcaaaatgataccatttatgataccggcaatcaaaccagcaattggtaaagttaaaaaccaaccagaataacaccaggctaccattctccaattaactgatttgagatccttgttacataaaccaacagcgacaataccaccaacggcgatctgggttgttgaggtaggaatacctaattgggtagccatgacagtagtaatagcaacagctagttcaattgaaaagcctcttgatggcgactgcaaaatcatcttattacctagatttttgataatattgtaaccataagtccagcaaccaataactaaggcaacaccaccataagccagaacccacacgggaacttcggactttgccccaatagtgttagttttccagatcacatacacagcagacaaaggaccagtagcgttggcaacgtcattagctccatgagcaaaagacatagtggctgcagtaatggcttggagaaccgaatagatatattctactctattgtcgtaaaatttagatctttcgtacattcctttcaggtcaccagataacatatctctatcattaacttgagcatgaatgacgtcttgagtccaaccatgagagattactaaccagaacaataagggccattttttaggtccttgctttaataatgaccaccaatattgtttcgttgacaactttgtttctggttcagtttcagttctaaccaggtccacttcctggatgtcttctttgtttttgacggaatcattagaattactcgctgccttattttcttcgtcttcaacagaaacagttgttccaagatttcttctgccctcgtaataatcgattgttaattgatggccttctggcattggtgggatatcatcagtggacttaaagtaaaaagatggacctctgaaaatatcaatcaactttagtgtccaatcttggtccaaaacttttcttctgtagaatgggtagaaaaagatgaagtaaacgatcgaagcaattgcacctgtgagaacaatagatacggcagtttcagtttcagataaatcgtccaagtgtaggtttggagaacccttccagacaatcaacattgttaagatagagaaagtggcgaatactaaaacaccaaccagcagtaaagcattcttaatcgatctttccaaagacttaacttcaaggacagaaaacctagaaattgaaaaaactatagctgcgatcgcgcctgccaaaatcggagcaatgaaccatgacgcaataatttgagaaacaccactccaaccccaaacgacaccgttagctccaccggctgcaatcccagcgccaattgtaccaccaacaatggaatgtgtagtagaaactggcattccgattgcagtagcaaatgttaaccaacaagacgagccaatcaaagcactggtcatagtaagcattaaaacagcggggtcgttggtaaaaatggaggaatctataatgttgttcttgatagtaccagaaactcttgcgcctgccaagacagcacccaagaactcacagagacccgccaaaaccatggcttgccagtattttagagatctagaagagatcgacgacgcgaatgagttcgccacgtcgtttgccccgatgttaaaggcatccaaaaatgcaaataacatggcaatggcaaaaatatagtcaaattgatgtaaagccatttttgcttaatctttgtttatattgattcgattagatacgctccagtattctcacctttgatctatgtcactcattctatgacaattcatgtaaaataacctcaatgtaaagatcatcttcagcaggtttatatataattttcttcatatcgaaaaccgggcttagtgacatgaattgtttggagatgtccacccagtagacattgtaaaaaaaatctgctattgactgagttaatctaatgatttacataatagaaggatccaaagtggctgtgacatctagtattgatagattagtattattactatttgtctcccacgtgctgcattgtcatatgcaatttattaagattacataaactcctttgtacggtatattcttaaagcctttcaatgactcgggccaatttttagcaatatttcgacatttaagggcccactaacaaattaatggcacaacgtggggatgacgaaaaagcagaaaaagaaaaaaaaggtctatcgcacagccacacacccttgtggtgaagccgttttgtgatcggtgtggcgcgatctgtgaaatttaaacttttttgcgggtgaaaccgagatttctgaaactagattttctggcttcgccaaagaaagatgcatcgaattaatgaaattaaacggatgtaaggaatgaaattataacgattccgctaatgttctttactgacgagtgtcactgaagtacttactcgtgaacaaaaattaacctatatcagtaattttgatattgttaaaagtaggtatctctatcaaaagagattataagacccatcggcaaaactcgaaatatcgtcttgagaaaatcattatacagtacatggtgcaattttaaatgatttttaaatactattatataatcgatacatttagtacacgcgaagacaacgtagtgttgagattcaaagaggttacagttgaatacgtgacaaagctgacgagagtactgtgaattcaacaaaccataaatggtcactccaagtaacggtattgtgatttcaacagaaaacacaagcattgtgttagcgtgctcgtaaaatattatttcagcggtgaagcagatatgcgttaaaggtgggctcgctattaaatcatgaacgaaaaaacagttatgtcgttactggtgtgagtcgatattacgaaaccactggcaggtagatggatagaatgggactgattggaacagcgcaagtttttttccgtggtcggaattctcgtagtaatattggaaaatagttggaagaaaaattgtgtgaaaaaatacatgctgaaatagtcaaacgaagagaggtgaagaatagataaagctgttgagaggcaagacaatgttttcaagatgatcagaaaaggatacggtccaatatctatttatattcattgccctaccgtggtatgttaaaaaaatatgttacatttattgctcccattggattttgcacaggtgtgaaagagctcagttgtcaagatttagtcattaagaagggccgcagcagctttttgtataatagagcgtcttttttgtttgtgaaaaaaattttatggtgagatattgttcgattctacgaagtcattttactagtttatggactctgatataagacagagttgacaaggaaatggtgccgtgattgtttccgtgtacagcttttgagaacttccttgaaaaccaatcatctagcactttcatttctggggaaaaacctggaaccaaatcttgaaaaataaattccccagaagttttccttattccgtgttctaatcttctcgttcactttgcagtgacattccacggccatgcgcaatttaccccgcccccggattttattgtccgtaccgccatttttcaatagattaaaaaggaacaaaaaatcatttcagaaggtttctttctcgggaaaacactagagtgtaaatattgaatatcaaacatcgaacgagagcatcttgaagatatttatgttctaaatatgactttagtcaagtatgcatgcgactattgtcgtgtccgtcgagtaaagtgtgatggtaaaaaaccatgtagtcgctgtattgagcacaatttcgattgcacatatcagcaaccattaaaaaaaagaggctcaaagcctattggaactagaagcttaaagtatataccaaaggccaaaatgtttatagataataaaagttgtacggcagcggcagaaatattaatgaaggttcctaaaaaggtgattgatcagtgtttgaggctttatcacgacaatctatatgttatctggcctttactctcttatgatgaccttcacaagcttttggacgaagaatacaatgaccattacgtttattggtttctcgtagctctttcagcagccaatcttagcgatctacaaagcgaattagaatctgaggggggattttcgtttactggaaaacaattagccgttctctgtatgtcctcacgccaacaatttgatgaccttagcggcagagacattttccgaattatgacatattattgcttgctacgttgtttttcacagtcttctgatgtaagaaattcatacagactttgtcgtgaagctattggccttgttattgtagcagggttacatcgtgaaaaagcatacgaatcactatcatttcgtgagcaacagcttttacgcaaggtgtattatttgcttctcttgacggaaagatactattccgtatatgttcattgtgttacaagtttggataccacaatagctccacctcagccagagttcgtaacggaccctcgactttctttggatagcttttttgagatgattagagtatttactgtaccaggtaaatgcttttttgatgctttggctacggagtctactagcggttcttgcactgaagactcactgaaaaaaatatggaaagagcttcacacagcatcccttgaaatagaaccatggtcttatggctatgtggacatttcattttctcgacattggattagggcgctggcttggaagctagtgtttcagatgaatggtaccaagtttttctcaaacgccaataatgctcacatattggtcgaaattgcaaaggatatgctggacgacatattcttaactccaaacaacctgtatgatgtacatggtcctggaataccaatgaaatcattggaagtagccaatgcattggtagatatcgtaaataagtatgatcacaatatgaagttggaggcttggaatattttgtgcgatgtatccaagttcgttttctccctgaaacattgcaatcataaaatgtttcaaaggttttcaactaaatgtcagagtgctctaatcgatttgcctatctctagaccactgcgcctaaatgatgattccaaagatgaagacgacataattccttaatttattgttcacgccgttcacttatacgagatagatatactgatagagtgtgagtgatattcttaagtcttgcttttcgagggtgtaagaagctatgttcttcaggcgagattattctactcctgccttacttgtttgtaatatttagttctgatggtcatgataattctatatacagttacattaagtatatacttaagcgggcagcttactaatataaattttgtggcatttttgttgggatatgagaatcatgtatcgttgatttacaaagcgaatttacgttaccaggaatagggaatactctcttgaattctaacataagcacagaaatgctgaaagaatacgtcaaaaagtaaatttacagaattaaaaaaaaaataattgttgccggaacatgaatagagtgtatcaatatacaatataaaaattcaagcattttcattaacgggaatgaaaaaattgtatattagtacttctttttgcaagatatttaaatctaggaccctcatcacaatgattcatttaaatcattaacgttttttcagaacaaaataataacctctagttgaaaaaacttcaaagccgcaacaaaaccaaaaaaaagtcataatgtcgagtaaaaataaactcgatgtgttaagtactagttatataaaataaaattaaataacgccgtatctacctactggctaaaaaaatcatttgttcacaacagatgaggtgtttcgcccttcatctaccacagaagtttccaaatcttccttcggatctttaacattaatttctgcagctgctgctttggcagctgcaaaagggtcgactttagtcgacttgaactttcttgctggaacaccaagtctaaacaattcatttatctcaataaaagtcctgccagcggtttctggtaaatcgacaacagcccaagctaaagtggccagacaaaatcctccccagaaaaagcctgatttagcaccccaattccatttctctgagttcaattggtacatgatcaaaactgtaactacaacttggatcacattgtaagcattacgagccaaaataattgttttggttcttagccttgaagacggtatttcagacactaagcaaaaaacaacaggtgcaataccgaggttgtaaaagaacgcgacaaccattagaagagcaccactacccattttagcgccatgagtgtctgaacatcctaaaccaccgataatgaagaacataatagcctgaaaagccagcccaaaagcataaaggtcaaatctgccacaatattttgaagcccaccaggatataaacgttgcagcaataccaagacaatattggataatactgaaagtaaaagccgtatcagtgctaacaccagctttttcataaaagtaagttgaataaccaattaatgatgcaccacaggagcattgaccgatccaacataaacaagctattctcgttcttctcctgttaataccatctttcacacaatcccagtaagttccttcatcagacattttctgctccttttctatagtagttttgattttatcgagttccatactcactagtaattctttctcgggtcctttaccacttaatgttctttcaagtgatctcctcgcttgatcaatccttccttttttaaccagccaccatggagactctggtgcaaaaaaaatacctaccgccaaaggaaggggccagatccactgcaaagcaaaaggtagcttatatcctagttctgagttggcatatttgttctgggaatttttcataataccagcagcgaaaagttgaccgaacgcccaacataaattagaataagtcgtcaaatagtatcttagggccaaaggacaaatttcagaagcataagaaacggtcaaacattggaaacaaccccatggcataccacacaatgcctgtcccacggcaatcatacccaaactcttgcaaaaatacagaatgaaaatgaaagccgctaaaaagaacaacgccatgatcagagtgtaacggttgcccatgtaatctacagaaggcccagtcatttgcaaaccgacaatctcacctgccatgtagcatagacatagaccgatttgccaggaaactgaaatttcataatctcctgtattgctattcaaagaaccatattttttttgaaaaacaggcagggcatagaaagctcctagaatggctgtgtcataaccctcttgaatcaatgttgtggaaactaatagtgaccaagcagcagcttttggatatgtcttcaaagctgtcatgagtggcattcccctctcactttcatctgcctctttggcgtcctgcatagcttcatcgagaaggtcggggacttcttcattattatcgtttggtattagtgaacctggaccgtactcaagatgggaaagatcaaaatcacttttcttaccttgctcctccatctctatcgagttgaattcggtagcgttcacgccattctcgatctcatctaagtgtgagtcgttcctgtctttttttctgtttattaatgaggataatcccttcatagttaattaatagtcttggatgtaattcttattgttatactgaatacgctaaaaccactcacaacaagtatggagtatattgtgtctctttatatactgagtacttatgcaatatgcgctcactcaggatgaaatgtacacagccgaaagtatattgaaagctgcctctgtggaaacttctatctaatgttgtctccagatgtagactatgaggcctgaagaagtctttaaacacctgttggagagtataaggagactgctacaacaacgtcttccccacaaaaattatgtggaggccggtatgatacctgcacaaacgttaagttacacatgaaaaagagactgacataactttgatctctgaaaatatgttttcccctgagtagcttcactgcttggataccaatacgaatagaccttggctatagtaagttgcatctgtaccgtagagattcttgcaacctcgcttaaactctcgcttttatataatatttctccttattgcgcgcttcgttgaaaatttcgctaaacacggggtttaagtttaagtttacaggatttatccggaagttttcgcggaccccacacaattaagaattggctcgaagagtgataacgcatacttttcttttcttttttcagttcctagcgtacctaacgtaggtaacatgatttggatcgtgggatgatacaaacaacgtaagatgagtagttccttcctcaattcttctttcagcatcattttcttgaggcgctctgggcaaggtataaaaagttccattaatacgtctctaaaaaattaaaccatctatctcttaagcagtttttttgataatctcaaatgtacatcagtcaagcgtaactaaaatacataaatgactatttctgatcatccagaaacagaaccaaagtggtggaaagaggccacaatctatcaaatttacccagcaagttttaaagactccaataacgatggctggggtgatttaaaaggtatcacttccaagttgcagtatattaaagatcttggcgttgatgctatttgggtttgtccgttttatgactctcctcaacaagatatggggtatgatatatctaactacgaaaaggtctggcccacatacggtaccaacgaggactgttttgagctaattgacaagactcataagctgggtatgaaattcatcaccgatttggttatcaaccactgttctacagaacacgaatggttcaaagagagcagatcctcgaagaccaatccgaagcgtgactggttcttctggagacctcctaaaggttatgacgccgaaggcaagccaattcctccaaacaattggaaatctttctttggtggttcagcttggacttttgatgaaactacaaatgaattttacctccgtttgtttgcgagtcgtcaagttgacttgaattgggagaatgaagactgcagaagggcaatctttgaaagtgctgttggattttggctggaccatggtgtagatggttttagaatcgataccgctggtttgtattcgaaacgtcctggtttaccagattccccaatttttgacaaaacctcgaaattacaacatccaaattgggggtctcacaatggtcctaggattcatgaatatcatcaagaactacacagatttatgaaaaacagggtgaaagatggtagagaaataatgacagtcggtgaagttgcccatggaagtgataatgctttatacaccagtgcagctagatacgaagtcagcgaagttttctccttcacgcacgttgaacttggtacctcgccatttttccgttataacatagtgcccttcaccttgaaacaatggaaagaagccattgcatcgaactttttgttcattaacggtactgatagttgggctaccacctacatcgagaatcacgatcaagcccggtcaattacgagatttgctgacgattcgccaaagtaccgtaaaatatctggtaagctgttaacattgctagaatgttcattgacaggtacgttgtatgtctatcaaggtcaggagataggccagatcaatttcaaggaatggcctattgaaaagtatgaggacgttgatgtgaaaaacaactacgagattatcaaaaaaagttttggtaaaaactcgaaggaaatgaaggatttttttaaaggaatcgccctactttctagagatcattcgagaactcccatgccatggacgaaagataagcccaatgctggatttactggcccagatgttaaaccttggtttttcttgaatgaatcttttgagcaaggaatcaatgttgagcaggaatccagagatgatgactcagttctcaatttttggaaaagggccttgcaagccagaaagaaatataaggaacttatgatttatggttacgatttccaattcattgatttagacagtgaccagatctttagcttcactaaagagtacgaagacaagacgctgtttgctgctttgaatttcagtggcgaagaaattgaattcagcctcccaagagaaggtgcttctttatcttttattcttggaaattatgatgatactgacgtttcctccagagttttgaaaccatgggaaggtagaatctacctcgtcaaataaaattagtgccgacttttttttagcgcgtactttaacgaaataacagatgatttttcacatgatttttgttagataaattttttatatgtaaatgatgataacgtaaaagcactgttgataatttgtttcaccattatgggtaaatgtgtttttctacatgatcctcgttcattatgatatttagcgtgtatataaatgtgaattccaaattattaatgaagcataagaagcactatcctttctcttcggatgaaaacaagggagaagaaacctgtgctggtattaatgctggaatgtcttgctaagaatcatacaaggtggtagttttatttaataaagaaaagaaaaggactagatataaaaagtgaaatgaatataagatagcgttaagagatgcccacagtacttgacacataatttagcgttttctcgggaagctctgtgattttatgattcaataacacagcgtaattgatttcgtgatggttcgatcctatatgtaatctcatgtaacactcaggcgagttacaaaatcgattcaacattgccggcttatgcgtttacgtcaagtctgagcatgcctacccccttccgaacccgccttttattgtctagccttcagatgaactaaaccaatcatctgtccataatccatatgctttagacagtgtgattaagcaaaagaaaataagcgcataagaatcttgctacttcggtaactctacaacattaacaccccacaatcaatatataaaagccaacgaagtgaagagaagaggtggaatgacgctcttatcctttgagaaatttgactacgaaaatctgtgtcccctatgccattagttattgagctataactatatatcagagaagtgtagttattcttcagcaacgggcctataatctggatacgtatgattacttatcgctgtaataattgtaaattcctggaagaaaaacacatgaccagaatgatagacatattgaaacggtgaataaaagggagaaaaaggcttaaaggctttctgtattagtaacactaagccctctatcaatttcatccaaacagaaagactgcaggtacatccataggatagaagttctgtatgtaagccgccactttttgtctccttcacttaccatataatgaatagagaaacgtagacctaggcggcaaccgttgcctaacatacgaagcgctggtgctgttctccgattattagtattacaaaaaaaattatataatacttattaagatgttgatttatcaatttccggtatagtttccggtatggccagcttgatccagtggaagttccgctgtttcagaactagggcttcgtagcacctcgaatgctcatttattcttgtcaacatttttgctggcagtgtataagactgtaggcacctacaatatacgactccggtattcgataagtctttcactttctattttaagaaaaacagaatcgacaattttcccgtagcaaccgtttagagcacaaagattaggtggcctcttaacgagggttcaaagcaaatttggttttggctttttcttggccaaaagctgcagctgcatctctgaaggcaccctaaagggattcttcggaagtatgtacactgtgagaaaacattcttgtgccttggaaatgcaataaaaggtataggcactatgaagcgtgcgcctcgtatacgggacctatgaaagacgcatcgttcaagtacagaagcaccgtaataatatgaataatgaatgtgggatgaaaattgtacactgaggcattttaggtgagagatgggtgccagatgataactcgtttgtgccagggaagttggcaagacattcatataaatagagctgctgtagctatccatctttgaggtatgcgctttcatttcactatttcttgttaagcttacatcagcactaaaaaacaaaacaaatacaatggtcaaactaacttcaatcgctgctggtgttgccgccatcgctgctactgcttccgcaaccaccactctagctcaatctgacgaaagagtcaacttggttgaattgggtgtctacgtctctgatatcagagctcacttggcccaatactactctttccaagtcgctcatccaactgaaacctacccagttgaaatcgctgaagccgttttcaactacggtgacttcaccaccatgttgaccggtattgccccagaccaagtgaccagaatgatcaccggtgtcccatggtactccagcagattaaagccagccatctctagtgctctatccaaggacggtatctacactatcgcaaactagagactgatgcctttacgaatgaaattccataaaccttaagaaataacggaaaaaaaaaaaaaagctttttttttttttgatagtataaatagttgattatatgtaagtgtatattaatattgttactactggtcaatcgtgatatttatgaacaacttggcggagcaaggacaagaatcctctcttccttttgtggtattcttcgatgtgtgtccacttcaacgacatgggtcatcaatatctatgttaaaaaatcatattttagactcacttgctagtaaaccggttgatgctattgttaatatataacgacaaatgttcaagcaattatataaccattttcttccatattcaccttaaacgaggtcgcctttatttttttttttttttttttcagggcatcgatcggcccggagtcgtcgccttcaaatgtgtcaaatttttaagattaaagttatcgatcttgaagtttttcgtggcaggagggtttctatttagtgttcaataaaggctttcatgagcttttgtatattccttgattaacaataaatgtggaaaacaagaagggtaattgtgaaagagtccgattgtagttgatgaacagtaaaatcacttattatttaaggattccgctgcggtatgcgttttctactgatgtgtggagcaagccacgccatgtgattaaccttgcttgataaaaacacaaaccatcgttcagaatatgcatggaatatagcatcactgggaggagaaagacaataagttttgcgcatatggtaggatggtggcacatcgagttctctcaaccagtgagaaatagggaaaaagaaaatggttgtaatggtaaaaagtagtctcgttttggtaattcgcagctgacaaactacaaaatatataaattgaaaaagttgtatttatctctacactaagagcacctcactgcgggataattgcgcttctttaatgtatggccatagttccacattcaatggtaaaggccacatagatttcttcgcagatagaacgcggtagaagaagtggttaaaaaaccattcacagtcaatcccgtcgaagaaaaactcttcattcttccaggcttttttctcaaacaagtacctattcattttccttgcaatttcgtcccatccattcgcaccactttcttgctcatttataatagtcgacaagaactgcatcttgtgttccatgctcataatcaaaacccttatattttggaaaccttgtaccaacatgaaaagaatccacccgagatacaaggtgcgtaatagaaggcacattccccgtgacacatatatgcagcacaaaaaattaaggaatggtatcaacataaaaatattggaaatcctctttaaaaaccaagtaagcttaaatcggtaagcttccttgggaagtttagcatcttccaggccaacagggctccatgatttttcagtattaaacaatttccattgtttttcaacttctgtaaaataaactcccaatgcttcttcaatgtaagggacggaatccttaaatgacttaaccttggcagctttatcttttttcaaagaaaatggttcgagaagggttgttctgaacgcttcttgacagaccatggcattgaaaaaaaagtacttagtattccaaacgttattttcatataagtacgaatttagatttgctgcaacaacttcccaatcatgaggatcagaacttggtgtgttttcagtaatctctttgcaaaactgaatgagttgtttcgataaggaacgcttacgagaaagtccacaaataacaaggacaaatattggtcccagaaacaggaccagaagtgaaactataagtgggtaaatacaattgttggaaagtttccaccagacgctaagtggtagccataatagcatccagatgcgaaacgctaaggacttgtaaatttcataacaaaaccaggtaaagctgcttctgaaaagatcttgaggtagaacaatcttttgggattcgagctgtttgaaggataatacatctacactcttctcatttttaagttcattctctttcattttcggtagtgagatggcagttcgaggggttttttattcgagatagtaacttctggcttttcgcttttatacagcacagcagaaaaaaaaagccgccgaggcgcgcgcgttcatgcaatggctcagtaacctcgtgatagaaaaagggcaacaatattgggctattttaggcaaagaaactcagctattcgaaaagggcatccattacatttccggttttctatctagccaactcgataatcgtaataacgaatttacaaaactttaatgcgggtacatcacggtgtgccgtaacgttggttcacatttagggtgcgaccagcaatgtcactgctcgtacagcggttaccgcttgaatgaaatacatattttaagcgtagatttcctgtgacaaaactgtgtaaacatctagtagaaaatagacgtagctgtcacaaatatttacacaggaaagagtctgtcctacgtatctgacatgaagattcatagaaccaagttacttcccaatgtggacaacctttcgataccatgtcaatagcttccccttatgttcggtgtcactgtaaaacggatcaaagcaaaacctagaggtacggtggtactcagatcatgcatgacctctgggtaattagcacttctcccgcttgttttgagattctgtatataaatattgcaaacaaaaggatagagcgcggatggcagcccttacagtaaaaattattcgttttaatcatgcgtcagtgtgagattctatgacaatagtataagatggggtgaagtaaaagcgtctgtatgactatagagtacagttatattacaatatatggaatagagcatagtggtatgacgatattaaggaactttaagttaatgataccatgatagtattaagacgcaattaagtgtgtttatgtattatggttgaaggatagaatatttttatgtttaggtgattttagtggtgatttttttgtaatattggcataagtgtatataaattgagtggttagtatacggtgtaaaagtggtataacgtatgtattaagagctgttatacaatacttggggccgccgaatgagatatagatattaaaatgtggataattgggagttatgcgtaaatggcacagggtatagaccgctgaggcaagtgccgtgaataatgatgtgagtgcatttggtactgatttagtgagaatggggccatggtgtggaatatgaaagtagggtaagtttgagatggtatatactgtagcatccgtgtgcgtatgacatatcagtagaagtgaaggtgagtgtggcaagtggcggtggtggtagtggtggtatagagtggtagggtaagtatgtatgtattatttacgatcatttgttaacgtttcaatatggagggtagaacaacagtacagtgagtaggacatggtggatggtagggtaatagtagggtaagtggtagtggagttggatatgggtaattggagggtaacggttatggtggacggtggttagtggtaagtagagagatgatggatggtggttgggagtggtatggttgaatgagacagggtaacgagtggggaggtagggtaatggagggtaggtttggagacaggttcatcagggttagaatagggtactgttaggattgtgttagggtgtgtgggtgtgggtgtggtgtgtgtgggtgtggtgtgtgggtgtgt

SEQ ID NO: 2 - DNA, 27 bp, Artificial Sequence
  Synthetic Polynucleotide
  misc_feature: Region 624778-624804
atataaaagagaggaggggagagaaaa

SEQ ID NO: 3 - DNA, 701 bp, Artificial Sequence
  Synthetic Polynucleotide
  misc_feature: Region 624500-625200
tgtatgatcgttgagaacaaaattcgtccttgtagttgtgtgtgtctttagaagccattcgggccggtagaaggaaaggtgttgttagtcccagagtgatgtaagcaacataaaacaacgtcgtcagctttttactgggagcacttgccttgtatgatttagaaacttgtgaaaatgatttcatggccagcattgttagtcctcgatcttttgtgatatttcctatatattataaagaaattcttggttttcgccttgccacagggaataaatgtggaatataaaagagaggaggggagagaaaagaagaaaaaaaacttggtgtccgtttgaagatggcctattatataccctgcttatataactctgagaattaggaatattttgctgttgctatggtaattaacatatttccaacaataatgaccttctcgagctattgtcttccttgcagtggcgaagaaaccaccggagagttgcaacgaactgcctttcttaggaagtgcgcgggctctctattatgataggccgatacggtacaaaagcttaaagttgcctttgtattacctttttcaatcgcagcaaacaatgcgaagcacaggtgttcactttccttagcttccccttttccgtgcttttgtttatagttcgtacaaaaatgaggggaaggtaccaggcaggatacctcactgattacgaag

SEQ ID NO: 4 - DNA, 104 bp, Artificial Sequence
  Synthetic Polynucleotide
  misc_feature: Region 624739-624842
attcttggttttcgccttgccacagggaataaatgtggaatataaaagagaggaggggagagaaaagaagaaaaaaaacttggtgtccgtttgaagatggccta

The invention claimed is:

1. A method of producing alcohol, the method comprising fermenting glucose using a *Saccharomyces* strain in which expression of the MCM7 gene is induced in the presence of acetic acid and/or that comprises a Haa1p binding site in the sequence upstream of the MCM7 gene and/or comprises a base G at position 624794 on chromosome II of the yeast genome.

2. The method according to claim 1, wherein the *Saccharomyces* strain comprises the sequence SEQ ID NO: 3 or SEQ ID NO: 4 upstream of the MCM7 gene.

3. A method for characterizing a *Saccharomyces* strain for resistance to acetic acid during glucose fermentation, comprising the following steps:
   detecting induction of MCM7 gene expression in the presence of acetic acid; and/or
   detecting the presence of a Haa1p binding site in the sequence upstream of the MCM7 gene in at least at one allele of the strain; and/or
   detecting the presence of a base G at position 624794 on chromosome II in at least at one allele of the strain.

4. A method for obtaining a *Saccharomyces* strain resistant to acetic acid during glucose fermentation, comprising the following steps:
   performing a sporulation step for a first parental *Saccharomyces* strain and a second parental *Saccharomyces* strain having different genomes to generate segregants;
   performing a mass hybridization step for the segregants obtained; and
   selecting segregants in which expression of MCM7 gene is induced by the presence of acetic acid and/or comprise a Haa1p binding site in the sequence upstream of MCM7 and/or comprise a base G at position 624794 on chromosome II, thereby obtaining a *Saccharomyces* strain resistant to acetic acid during glucose fermentation.

5. The method according to claim 4, characterized in that it comprises the following steps:
   a) preparing segregants from a first *Saccharomyces* parental strain and segregants from a second parental *Saccharomyces* strain;
   b) selecting from among the segregants from step a) those in which expression of the MCM7 gene is induced by the presence of acetic acid and/or those having a Haa1p binding site in the sequence upstream of MCM7 and/or those having a base G at position 624794 on chromosome II;
   c) hybridizing the segregants from the first parental *Saccharomyces* strain selected in step b) with segregants from the second parental *Saccharomyces* strain, optionally selected in step b); and
   d) selecting among the hybrids from step c) those resistant to acetic acid.

6. The method according to claim 4, characterized in that the first parental *Saccharomyces* strain resists acetic acid and the second parental *Saccharomyces* strain exhibits another characteristic of interest.

7. The method according to claim 4, characterized in that the first parental *Saccharomyces* strain is the strain EGAc1 deposited at the CNCM under number I-4839 on Mar. 13, 2014 and the second parental *Saccharomyces* strain is the strain deposited at the CNCM under number I-4538 on Oct. 5, 2011.

8. The method according to claim 3, characterized in that the first parental *Saccharomyces* strain resists acetic acid on a medium comprising glucose.

9. The method of claim 3, wherein the Haa1p binding site in the sequence upstream of the MCM7 gene comprises the sequence set forth in SEQ ID NO: 3 or SEQ ID NO: 4.

10. The method of claim 4, wherein the Haa1p binding site in the sequence upstream of the MCM7 gene comprises the sequence set forth in SEQ ID NO: 3 or SEQ ID NO: 4.

11. The method of claim 6, wherein the second parental *Saccharomyces* strain metabolizes xylose.

12. The method according to claim 3 characterized in that the *Saccharomyces* strain is *Saccharomyces cerevisiae*.

13. The method according to claim 4 characterized in that the *Saccharomyces* strain is *Saccharomyces cerevisiae*.

14. The method according to claim 1 characterized in that the *Saccharomyces* strain is *Saccharomyces cerevisiae*.

* * * * *